United States Patent 7,026,443 (INDUCING CELLULAR IMMUNE RESPONSES TO HUMAN PAPILLOMAVIRUS USING PEPTIDE AND NUCLEIC ACID COMPOSITIONS) - sequence listing, part 3

SEQ ID NO: 35908 - protein, 11 aa, Artificial Sequence
  Peptide Derived from Human Papillomavirus
GISFMELVRPF

SEQ ID NO: 35909 - protein, 11 aa, Artificial Sequence
  Peptide Derived from Human Papillomavirus
GISPSVAESLK

SEQ ID NO: 35910 - protein, 8 aa, Artificial Sequence
  Peptide Derived from Human Papillomavirus
GMGCTGWF

SEQ ID NO: 35911 - protein, 9 aa, Artificial Sequence
  Peptide Derived from Human Papillomavirus
GMSLIQFLK

SEQ ID NO: 35912 - protein, 8 aa, Artificial Sequence
  Peptide Derived from Human Papillomavirus
GTDSRWPY

SEQ ID NO: 35913 - protein, 10 aa, Artificial Sequence
  Peptide Derived from Human Papillomavirus
GTDSRWPYLH

SEQ ID NO: 35914 - protein, 9 aa, Artificial Sequence
  Peptide Derived from Human Papillomavirus
GTTPEWIDR

SEQ ID NO: 35915 - protein, 10 aa, Artificial Sequence
  Peptide Derived from Human Papillomavirus
HFWLQPLSDA

SEQ ID NO: 35916 - protein, 11 aa, Artificial Sequence
  Peptide Derived from Human Papillomavirus
HFWLQPLSDAK

SEQ ID NO: 35917 - protein, 8 aa, Artificial Sequence
  Peptide Derived from Human Papillomavirus
HGGNISTF

SEQ ID NO: 35918 - protein, 9 aa, Artificial Sequence
  Peptide Derived from Human Papillomavirus
HGGNISTFK

SEQ ID NO: 35919 - protein, 9 aa, Artificial Sequence
  Peptide Derived from Human Papillomavirus
HLQCLTCDR

SEQ ID NO: 35920 - protein, 8 aa, Artificial Sequence
  Peptide Derived from Human Papillomavirus
HSFNDNIF

SEQ ID NO: 35921 - protein, 9 aa, Artificial Sequence
  Peptide Derived from Human Papillomavirus
HSRLTVFEF

SEQ ID NO: 35922 - protein, 10 aa, Artificial Sequence
  Peptide Derived from Human Papillomavirus
HSRLTVFEFK

SEQ ID NO: 35923 - protein, 11 aa, Artificial Sequence
  Peptide Derived from Human Papillomavirus
HSSNTKANILY

SEQ ID NO: 35924 - protein, 9 aa, Artificial Sequence
  Peptide Derived from Human Papillomavirus
IAYYYAQLA

SEQ ID NO: 35925 - protein, 9 aa, Artificial Sequence
  Peptide Derived from Human Papillomavirus
ICGPANTGK

SEQ ID NO: 35926 - protein, 11 aa, Artificial Sequence
  Peptide Derived from Human Papillomavirus
ICGPANTGKSY

SEQ ID NO: 35927 - protein, 11 aa, Artificial Sequence
  Peptide Derived from Human Papillomavirus
IDDSMENSIQA

SEQ ID NO: 35928 - protein, 11 aa, Artificial Sequence
  Peptide Derived from Human Papillomavirus
IDDVTPISWTY

SEQ ID NO: 35929 - protein, 8 aa, Artificial Sequence
  Peptide Derived from Human Papillomavirus
IDDYMRNA

SEQ ID NO: 35930 - protein, 9 aa, Artificial Sequence
  Peptide Derived from Human Papillomavirus
IDELEDSGY

SEQ ID NO: 35931 - protein, 9 aa, Artificial Sequence
  Peptide Derived from Human Papillomavirus
IDRLTVLQH

SEQ ID NO: 35932 - protein, 11 aa, Artificial Sequence
  Peptide Derived from Human Papillomavirus
IDRLTVLQHSF

SEQ ID NO: 35933 - protein, 11 aa, Artificial Sequence
  Peptide Derived from Human Papillomavirus
IFDLSEMVQWA

SEQ ID NO: 35934 - protein, 8 aa, Artificial Sequence
  Peptide Derived from Human Papillomavirus
IGQWIQSR

SEQ ID NO: 35935 - protein, 11 aa, Artificial Sequence
  Peptide Derived from Human Papillomavirus
IGQWIQSRCEK

SEQ ID NO: 35936 - protein, 8 aa, Artificial Sequence
  Peptide Derived from Human Papillomavirus
IIILLLIR

SEQ ID NO: 35937 - protein, 9 aa, Artificial Sequence
  Peptide Derived from Human Papillomavirus
IIILLLIRF

SEQ ID NO: 35938 - protein, 10 aa, Artificial Sequence
  Peptide Derived from Human Papillomavirus
IIILLLIRFR

SEQ ID NO: 35939 - protein, 8 aa, Artificial Sequence
  Peptide Derived from Human Papillomavirus
IILLLIRF

SEQ ID NO: 35940 - protein, 9 aa, Artificial Sequence
  Peptide Derived from Human Papillomavirus
IILLLIRFR

SEQ ID NO: 35941 - protein, 8 aa, Artificial Sequence
  Peptide Derived from Human Papillomavirus
ILLLIRFR

SEQ ID NO: 35942 - protein, 11 aa, Artificial Sequence
  Peptide Derived from Human Papillomavirus
ILLLIRFRCSK

SEQ ID NO: 35943 - protein, 8 aa, Artificial Sequence
  Peptide Derived from Human Papillomavirus
ILYKFKEA

SEQ ID NO: 35944 - protein, 9 aa, Artificial Sequence
  Peptide Derived from Human Papillomavirus
ILYKFKEAY

SEQ ID NO: 35945 - protein, 8 aa, Artificial Sequence
  Peptide Derived from Human Papillomavirus
IMCRHYKK

SEQ ID NO: 35946 - protein, 9 aa, Artificial Sequence
  Peptide Derived from Human Papillomavirus
IMCRHYKKA

SEQ ID NO: 35947 - protein, 11 aa, Artificial Sequence
  Peptide Derived from Human Papillomavirus
IMCRHYKKAEK

SEQ ID NO: 35948 - protein, 9 aa, Artificial Sequence
  Peptide Derived from Human Papillomavirus
ISCVNSKSH

SEQ ID NO: 35949 - protein, 10 aa, Artificial Sequence
  Peptide Derived from Human Papillomavirus
ISCVNSKSHF

SEQ ID NO: 35950 - protein, 9 aa, Artificial Sequence
  Peptide Derived from Human Papillomavirus
ISEDEDETA

SEQ ID NO: 35951 - protein, 8 aa, Artificial Sequence
  Peptide Derived from Human Papillomavirus
ISFMELVR

SEQ ID NO: 35952 - protein, 10 aa, Artificial Sequence
  Peptide Derived from Human Papillomavirus
ISFMELVRPF

SEQ ID NO: 35953 - protein, 11 aa, Artificial Sequence
  Peptide Derived from Human Papillomavirus
ISFMELVRPFK

SEQ ID NO: 35954 - protein, 8 aa, Artificial Sequence
  Peptide Derived from Human Papillomavirus
ISIDVKHR

SEQ ID NO: 35955 - protein, 9 aa, Artificial Sequence
  Peptide Derived from Human Papillomavirus
ISIDVKHRA

SEQ ID NO: 35956 - protein, 11 aa, Artificial Sequence
  Peptide Derived from Human Papillomavirus
ISNVLHSSNTK

SEQ ID NO: 35957 - protein, 10 aa, Artificial Sequence
  Peptide Derived from Human Papillomavirus
ISPSVAESLK

SEQ ID NO: 35958 - protein, 8 aa, Artificial Sequence
  Peptide Derived from Human Papillomavirus
ISTFKCSA

SEQ ID NO: 35959 - protein, 9 aa, Artificial Sequence
  Peptide Derived from Human Papillomavirus
ISWTYIDDY

SEQ ID NO: 35960 - protein, 11 aa, Artificial Sequence
  Peptide Derived from Human Papillomavirus
ISWTYIDDYMR

SEQ ID NO: 35961 - protein, 11 aa, Artificial Sequence
  Peptide Derived from Human Papillomavirus
ITGYGISPSVA

SEQ ID NO: 35962 - protein, 10 aa, Artificial Sequence
  Peptide Derived from Human Papillomavirus
IVKDCGIMCR

SEQ ID NO: 35963 - protein, 11 aa, Artificial Sequence
  Peptide Derived from Human Papillomavirus
IVKDCGIMCRH

SEQ ID NO: 35964 - protein, 8 aa, Artificial Sequence
  Peptide Derived from Human Papillomavirus
KANILYKF

SEQ ID NO: 35965 - protein, 9 aa, Artificial Sequence
  Peptide Derived from Human Papillomavirus
KANILYKFK

SEQ ID NO: 35966 - protein, 11 aa, Artificial Sequence
  Peptide Derived from Human Papillomavirus
KANILYKFKEA

SEQ ID NO: 35967 - protein, 9 aa, Artificial Sequence
  Peptide Derived from Human Papillomavirus
KCSAGENTR

SEQ ID NO: 35968 - protein, 8 aa, Artificial Sequence
  Peptide Derived from Human Papillomavirus
KDCGIMCR

SEQ ID NO: 35969 - protein, 9 aa, Artificial Sequence
  Peptide Derived from Human Papillomavirus
KDCGIMCRH

SEQ ID NO: 35970 - protein, 10 aa, Artificial Sequence
  Peptide Derived from Human Papillomavirus
KDCGIMCRHY

SEQ ID NO: 35971 - protein, 11 aa, Artificial Sequence
  Peptide Derived from Human Papillomavirus
KDCGIMCRHYK

SEQ ID NO: 35972 - protein, 9 aa, Artificial Sequence
  Peptide Derived from Human Papillomavirus
KFAACSQSA

SEQ ID NO: 35973 - protein, 10 aa, Artificial Sequence
  Peptide Derived from Human Papillomavirus
KFAACSQSAA

SEQ ID NO: 35974 - protein, 10 aa, Artificial Sequence
  Peptide Derived from Human Papillomavirus
KFKEAYGISF

SEQ ID NO: 35975 - protein, 8 aa, Artificial Sequence
  Peptide Derived from Human Papillomavirus
KFLKGIPK

SEQ ID NO: 35976 - protein, 9 aa, Artificial Sequence
  Peptide Derived from Human Papillomavirus
KFLKGIPKK

SEQ ID NO: 35977 - protein, 11 aa, Artificial Sequence
  Peptide Derived from Human Papillomavirus
KGCVISCVNSK

SEQ ID NO: 35978 - protein, 10 aa, Artificial Sequence
  Peptide Derived from Human Papillomavirus
KIDELEDSGY

SEQ ID NO: 35979 - protein, 11 aa, Artificial Sequence
  Peptide Derived from Human Papillomavirus
KIVKDCGIMCR

SEQ ID NO: 35980 - protein, 10 aa, Artificial Sequence
  Peptide Derived from Human Papillomavirus
KLDLIEEEDK

SEQ ID NO: 35981 - protein, 8 aa, Artificial Sequence
  Peptide Derived from Human Papillomavirus
KLRSQTCA

SEQ ID NO: 35982 - protein, 10 aa, Artificial Sequence
  Peptide Derived from Human Papillomavirus
KLRSQTCALY

SEQ ID NO: 35983 - protein, 11 aa, Artificial Sequence
  Peptide Derived from Human Papillomavirus
KMSIGQWIQSR

SEQ ID NO: 35984 - protein, 10 aa, Artificial Sequence
  Peptide Derived from Human Papillomavirus
KSCMLICGPA

SEQ ID NO: 35985 - protein, 10 aa, Artificial Sequence
  Peptide Derived from Human Papillomavirus
KSFFSRTWCK

SEQ ID NO: 35986 - protein, 10 aa, Artificial Sequence
  Peptide Derived from Human Papillomavirus
KSNSQAKIVK

SEQ ID NO: 35987 - protein, 11 aa, Artificial Sequence
  Peptide Derived from Human Papillomavirus
KSYFGMSLIQF

SEQ ID NO: 35988 - protein, 9 aa, Artificial Sequence
  Peptide Derived from Human Papillomavirus
KTNDGGNWR

SEQ ID NO: 35989 - protein, 10 aa, Artificial Sequence
  Peptide Derived from Human Papillomavirus
KVLIKQHSLY

SEQ ID NO: 35990 - protein, 8 aa, Artificial Sequence
  Peptide Derived from Human Papillomavirus
LADSNSNA

SEQ ID NO: 35991 - protein, 9 aa, Artificial Sequence
  Peptide Derived from Human Papillomavirus
LADSNSNAA

SEQ ID NO: 35992 - protein, 10 aa, Artificial Sequence
  Peptide Derived from Human Papillomavirus
LADSNSNAAA

SEQ ID NO: 35993 - protein, 11 aa, Artificial Sequence
  Peptide Derived from Human Papillomavirus
LADSNSNAAAF

SEQ ID NO: 35994 - protein, 11 aa, Artificial Sequence
  Peptide Derived from Human Papillomavirus
LDGNEISIDVK

SEQ ID NO: 35995 - protein, 9 aa, Artificial Sequence
  Peptide Derived from Human Papillomavirus
LDLIEEEDK

SEQ ID NO: 35996 - protein, 9 aa, Artificial Sequence
  Peptide Derived from Human Papillomavirus
LGAFKKFLK

SEQ ID NO: 35997 - protein, 10 aa, Artificial Sequence
  Peptide Derived from Human Papillomavirus
LICGPANTGK

SEQ ID NO: 35998 - protein, 10 aa, Artificial Sequence
  Peptide Derived from Human Papillomavirus
LIEEEDKENH

SEQ ID NO: 35999 - protein, 8 aa, Artificial Sequence
  Peptide Derived from Human Papillomavirus
LIKQHSLY

SEQ ID NO: 36000 - protein, 10 aa, Artificial Sequence
  Peptide Derived from Human Papillomavirus
LIKQHSLYTH

SEQ ID NO: 36001 - protein, 8 aa, Artificial Sequence
  Peptide Derived from Human Papillomavirus
LIRFRCSK

SEQ ID NO: 36002 - protein, 10 aa, Artificial Sequence
  Peptide Derived from Human Papillomavirus
LIRFRCSKNR

SEQ ID NO: 36003 - protein, 9 aa, Artificial Sequence
  Peptide Derived from Human Papillomavirus
LLIRFRCSK

SEQ ID NO: 36004 - protein, 11 aa, Artificial Sequence
  Peptide Derived from Human Papillomavirus
LLIRFRCSKNR

SEQ ID NO: 36005 - protein, 10 aa, Artificial Sequence
  Peptide Derived from Human Papillomavirus
LLLIRFRCSK

SEQ ID NO: 36006 - protein, 9 aa, Artificial Sequence
  Peptide Derived from Human Papillomavirus
LLLTSNTNA

SEQ ID NO: 36007 - protein, 9 aa, Artificial Sequence
  Peptide Derived from Human Papillomavirus
LLRYQNIEF

SEQ ID NO: 36008 - protein, 11 aa, Artificial Sequence
  Peptide Derived from Human Papillomavirus
LLRYQNIEFTA

SEQ ID NO: 36009 - protein, 8 aa, Artificial Sequence
  Peptide Derived from Human Papillomavirus
LLTSNTNA

SEQ ID NO: 36010 - protein, 8 aa, Artificial Sequence
  Peptide Derived from Human Papillomavirus
LSEMVQWA

SEQ ID NO: 36011 - protein, 9 aa, Artificial Sequence
  Peptide Derived from Human Papillomavirus
LSEMVQWAY

SEQ ID NO: 36012 - protein, 8 aa, Artificial Sequence
  Peptide Derived from Human Papillomavirus
LTDDSDIA

SEQ ID NO: 36013 - protein, 9 aa, Artificial Sequence
  Peptide Derived from Human Papillomavirus
LTDDSDIAY

SEQ ID NO: 36014 - protein, 10 aa, Artificial Sequence
  Peptide Derived from Human Papillomavirus
LTDDSDIAYY

SEQ ID NO: 36015 - protein, 11 aa, Artificial Sequence
  Peptide Derived from Human Papillomavirus
LTDDSDIAYYY

SEQ ID NO: 36016 - protein, 10 aa, Artificial Sequence
  Peptide Derived from Human Papillomavirus
LTVFEFKNPF

SEQ ID NO: 36017 - protein, 8 aa, Artificial Sequence
  Peptide Derived from Human Papillomavirus
LTVLQHSF

SEQ ID NO: 36018 - protein, 9 aa, Artificial Sequence
  Peptide Derived from Human Papillomavirus
LVRPFKSDK

SEQ ID NO: 36019 - protein, 10 aa, Artificial Sequence
  Peptide Derived from Human Papillomavirus
MADPEGTNGA

SEQ ID NO: 36020 - protein, 8 aa, Artificial Sequence
  Peptide Derived from Human Papillomavirus
MCRHYKKA

SEQ ID NO: 36021 - protein, 10 aa, Artificial Sequence
  Peptide Derived from Human Papillomavirus
MCRHYKKAEK

SEQ ID NO: 36022 - protein, 11 aa, Artificial Sequence
  Peptide Derived from Human Papillomavirus
MCRHYKKAEKR

SEQ ID NO: 36023 - protein, 11 aa, Artificial Sequence
  Peptide Derived from Human Papillomavirus
MGCTGWFEVEA

SEQ ID NO: 36024 - protein, 11 aa, Artificial Sequence
  Peptide Derived from Human Papillomavirus
MLICGPANTGK

SEQ ID NO: 36025 - protein, 10 aa, Artificial Sequence
  Peptide Derived from Human Papillomavirus
MSIGQWIQSR

SEQ ID NO: 36026 - protein, 8 aa, Artificial Sequence
  Peptide Derived from Human Papillomavirus
MSLIQFLK

SEQ ID NO: 36027 - protein, 9 aa, Artificial Sequence
  Peptide Derived from Human Papillomavirus
MVIEPPKLR

SEQ ID NO: 36028 - protein, 10 aa, Artificial Sequence
  Peptide Derived from Human Papillomavirus
NAGTDSRWPY

SEQ ID NO: 36029 - protein, 8 aa, Artificial Sequence
  Peptide Derived from Human Papillomavirus
NAVCALKR

SEQ ID NO: 36030 - protein, 9 aa, Artificial Sequence
  Peptide Derived from Human Papillomavirus
NAVCALKRK

SEQ ID NO: 36031 - protein, 10 aa, Artificial Sequence
  Peptide Derived from Human Papillomavirus
NAVCALKRKF

SEQ ID NO: 36032 - protein, 11 aa, Artificial Sequence
  Peptide Derived from Human Papillomavirus
NAVCALKRKFA

SEQ ID NO: 36033 - protein, 8 aa, Artificial Sequence
  Peptide Derived from Human Papillomavirus
NDENWKSF

SEQ ID NO: 36034 - protein, 9 aa, Artificial Sequence
  Peptide Derived from Human Papillomavirus
NDENWKSFF

SEQ ID NO: 36035 - protein, 11 aa, Artificial Sequence
  Peptide Derived from Human Papillomavirus
NDENWKSFFSR

SEQ ID NO: 36036 - protein, 11 aa, Artificial Sequence
  Peptide Derived from Human Papillomavirus
NGAGMGCTGWF

SEQ ID NO: 36037 - protein, 10 aa, Artificial Sequence
  Peptide Derived from Human Papillomavirus
NIEFTAFLGA

SEQ ID NO: 36038 - protein, 11 aa, Artificial Sequence
  Peptide Derived from Human Papillomavirus
NIEFTAFLGAF

SEQ ID NO: 36039 - protein, 9 aa, Artificial Sequence
  Peptide Derived from Human Papillomavirus
NILYKFKEA

SEQ ID NO: 36040 - protein, 10 aa, Artificial Sequence
  Peptide Derived from Human Papillomavirus
NILYKFKEAY

SEQ ID NO: 36041 - protein, 11 aa, Artificial Sequence
  Peptide Derived from Human Papillomavirus
NIQEGEDDLNA

SEQ ID NO: 36042 - protein, 10 aa, Artificial Sequence
  Peptide Derived from Human Papillomavirus
NISEDEDETA

SEQ ID NO: 36043 - protein, 9 aa, Artificial Sequence
  Peptide Derived from Human Papillomavirus
NISTFKCSA

SEQ ID NO: 36044 - protein, 9 aa, Artificial Sequence
  Peptide Derived from Human Papillomavirus
NSIQADTEA

SEQ ID NO: 36045 - protein, 10 aa, Artificial Sequence
  Peptide Derived from Human Papillomavirus
NSIQADTEAA

SEQ ID NO: 36046 - protein, 11 aa, Artificial Sequence
  Peptide Derived from Human Papillomavirus
NSIQADTEAAR

SEQ ID NO: 36047 - protein, 9 aa, Artificial Sequence
  Peptide Derived from Human Papillomavirus
NSNAAAFLK

SEQ ID NO: 36048 - protein, 8 aa, Artificial Sequence
  Peptide Derived from Human Papillomavirus
NSQAKIVK

SEQ ID NO: 36049 - protein, 8 aa, Artificial Sequence
  Peptide Derived from Human Papillomavirus
NTKANILY

SEQ ID NO: 36050 - protein, 9 aa, Artificial Sequence
  Peptide Derived from Human Papillomavirus
NTKANILYK

SEQ ID NO: 36051 - protein, 10 aa, Artificial Sequence
  Peptide Derived from Human Papillomavirus
NTKANILYKF

SEQ ID NO: 36052 - protein, 11 aa, Artificial Sequence
  Peptide Derived from Human Papillomavirus
NTKANILYKFK

SEQ ID NO: 36053 - protein, 9 aa, Artificial Sequence
  Peptide Derived from Human Papillomavirus
NTNAGTDSR

SEQ ID NO: 36054 - protein, 9 aa, Artificial Sequence
  Peptide Derived from Human Papillomavirus
NVLHSSNTK

SEQ ID NO: 36055 - protein, 10 aa, Artificial Sequence
  Peptide Derived from Human Papillomavirus
NVLHSSNTKA

SEQ ID NO: 36056 - protein, 8 aa, Artificial Sequence
  Peptide Derived from Human Papillomavirus
PANTGKSY

SEQ ID NO: 36057 - protein, 9 aa, Artificial Sequence
  Peptide Derived from Human Papillomavirus
PANTGKSYF

SEQ ID NO: 36058 - protein, 8 aa, Artificial Sequence
  Peptide Derived from Human Papillomavirus
PCRTSINK

SEQ ID NO: 36059 - protein, 10 aa, Artificial Sequence
  Peptide Derived from Human Papillomavirus
PCRTSINKNK

SEQ ID NO: 36060 - protein, 10 aa, Artificial Sequence
  Peptide Derived from Human Papillomavirus
PFDENGNPVY

SEQ ID NO: 36061 - protein, 11 aa, Artificial Sequence
  Peptide Derived from Human Papillomavirus
PFDENGNPVYA

SEQ ID NO: 36062 - protein, 10 aa, Artificial Sequence
  Peptide Derived from Human Papillomavirus
PISWTYIDDY

SEQ ID NO: 36063 - protein, 8 aa, Artificial Sequence
  Peptide Derived from Human Papillomavirus
PIVQLLRY

SEQ ID NO: 36064 - protein, 10 aa, Artificial Sequence
  Peptide Derived from Human Papillomavirus
PLLLTSNTNA

SEQ ID NO: 36065 - protein, 8 aa, Artificial Sequence
  Peptide Derived from Human Papillomavirus
PSVAESLK

SEQ ID NO: 36066 - protein, 11 aa, Artificial Sequence
  Peptide Derived from Human Papillomavirus
PVYAINDENWK

SEQ ID NO: 36067 - protein, 8 aa, Artificial Sequence
  Peptide Derived from Human Papillomavirus
QADTEAAR

SEQ ID NO: 36068 - protein, 9 aa, Artificial Sequence
  Peptide Derived from Human Papillomavirus
QADTEAARA

SEQ ID NO: 36069 - protein, 11 aa, Artificial Sequence
  Peptide Derived from Human Papillomavirus
QADTEAARALF

SEQ ID NO: 36070 - protein, 10 aa, Artificial Sequence
  Peptide Derived from Human Papillomavirus
QGTTPEWIDR

SEQ ID NO: 36071 - protein, 9 aa, Artificial Sequence
  Peptide Derived from Human Papillomavirus
QLADSNSNA

SEQ ID NO: 36072 - protein, 10 aa, Artificial Sequence
  Peptide Derived from Human Papillomavirus
QLADSNSNAA

SEQ ID NO: 36073 - protein, 11 aa, Artificial Sequence
  Peptide Derived from Human Papillomavirus
QLADSNSNAAA

SEQ ID NO: 36074 - protein, 10 aa, Artificial Sequence
  Peptide Derived from Human Papillomavirus
QLLRYQNIEF

SEQ ID NO: 36075 - protein, 10 aa, Artificial Sequence
  Peptide Derived from Human Papillomavirus
QSAAEDVVDR

SEQ ID NO: 36076 - protein, 11 aa, Artificial Sequence
  Peptide Derived from Human Papillomavirus
QSAAEDVVDRA

SEQ ID NO: 36077 - protein, 8 aa, Artificial Sequence
  Peptide Derived from Human Papillomavirus
QTCALYWF

SEQ ID NO: 36078 - protein, 9 aa, Artificial Sequence
  Peptide Derived from Human Papillomavirus
QTCALYWFR

SEQ ID NO: 36079 - protein, 11 aa, Artificial Sequence
  Peptide Derived from Human Papillomavirus
QTCALYWFRTA

SEQ ID NO: 36080 - protein, 10 aa, Artificial Sequence
  Peptide Derived from Human Papillomavirus
RCSKNRLTVA

SEQ ID NO: 36081 - protein, 11 aa, Artificial Sequence
  Peptide Derived from Human Papillomavirus
RCSKNRLTVAK

SEQ ID NO: 36082 - protein, 8 aa, Artificial Sequence
  Peptide Derived from Human Papillomavirus
RFRCSKNR

SEQ ID NO: 36083 - protein, 10 aa, Artificial Sequence
  Peptide Derived from Human Papillomavirus
RGIIILLLIR

SEQ ID NO: 36084 - protein, 11 aa, Artificial Sequence
  Peptide Derived from Human Papillomavirus
RGIIILLLIRF

SEQ ID NO: 36085 - protein, 8 aa, Artificial Sequence
  Peptide Derived from Human Papillomavirus
RLTVFEFK

SEQ ID NO: 36086 - protein, 11 aa, Artificial Sequence
  Peptide Derived from Human Papillomavirus
RLTVFEFKNPF

SEQ ID NO: 36087 - protein, 9 aa, Artificial Sequence
  Peptide Derived from Human Papillomavirus
RLTVLQHSF

SEQ ID NO: 36088 - protein, 8 aa, Artificial Sequence
  Peptide Derived from Human Papillomavirus
RSQTCALY

SEQ ID NO: 36089 - protein, 10 aa, Artificial Sequence
  Peptide Derived from Human Papillomavirus
RSQTCALYWF

SEQ ID NO: 36090 - protein, 11 aa, Artificial Sequence
  Peptide Derived from Human Papillomavirus
RSQTCALYWFR

SEQ ID NO: 36091 - protein, 8 aa, Artificial Sequence
  Peptide Derived from Human Papillomavirus
RTSINKNK

SEQ ID NO: 36092 - protein, 9 aa, Artificial Sequence
  Peptide Derived from Human Papillomavirus
SAAEDVVDR

SEQ ID NO: 36093 - protein, 10 aa, Artificial Sequence
  Peptide Derived from Human Papillomavirus
SAAEDVVDRA

SEQ ID NO: 36094 - protein, 11 aa, Artificial Sequence
  Peptide Derived from Human Papillomavirus
SAAEDVVDRAA

SEQ ID NO: 36095 - protein, 10 aa, Artificial Sequence
  Peptide Derived from Human Papillomavirus
SAGENTRSLR

SEQ ID NO: 36096 - protein, 9 aa, Artificial Sequence
  Peptide Derived from Human Papillomavirus
SCMLICGPA

SEQ ID NO: 36097 - protein, 10 aa, Artificial Sequence
  Peptide Derived from Human Papillomavirus
SCTDWCITGY

SEQ ID NO: 36098 - protein, 8 aa, Artificial Sequence
  Peptide Derived from Human Papillomavirus
SCVNSKSH

SEQ ID NO: 36099 - protein, 9 aa, Artificial Sequence
  Peptide Derived from Human Papillomavirus
SCVNSKSHF

SEQ ID NO: 36100 - protein, 8 aa, Artificial Sequence
  Peptide Derived from Human Papillomavirus
SDIAYYYA

SEQ ID NO: 36101 - protein, 11 aa, Artificial Sequence
  Peptide Derived from Human Papillomavirus
SDIAYYYAQLA

SEQ ID NO: 36102 - protein, 9 aa, Artificial Sequence
  Peptide Derived from Human Papillomavirus
SFFSRTWCK

SEQ ID NO: 36103 - protein, 9 aa, Artificial Sequence
  Peptide Derived from Human Papillomavirus
SFMELVRPF

SEQ ID NO: 36104 - protein, 10 aa, Artificial Sequence
  Peptide Derived from Human Papillomavirus
SFMELVRPFK

SEQ ID NO: 36105 - protein, 8 aa, Artificial Sequence
  Peptide Derived from Human Papillomavirus
SGTDLLEF

SEQ ID NO: 36106 - protein, 8 aa, Artificial Sequence
  Peptide Derived from Human Papillomavirus
SIDVKHRA

SEQ ID NO: 36107 - protein, 9 aa, Artificial Sequence
  Peptide Derived from Human Papillomavirus
SIGQWIQSR

SEQ ID NO: 36108 - protein, 10 aa, Artificial Sequence
  Peptide Derived from Human Papillomavirus
SINKNKECTY

SEQ ID NO: 36109 - protein, 11 aa, Artificial Sequence
  Peptide Derived from Human Papillomavirus
SINKNKECTYR

SEQ ID NO: 36110 - protein, 8 aa, Artificial Sequence
  Peptide Derived from Human Papillomavirus
SIQADTEA

SEQ ID NO: 36111 - protein, 9 aa, Artificial Sequence
  Peptide Derived from Human Papillomavirus
SIQADTEAA

SEQ ID NO: 36112 - protein, 10 aa, Artificial Sequence
  Peptide Derived from Human Papillomavirus
SIQADTEAAR

SEQ ID NO: 36113 - protein, 11 aa, Artificial Sequence
  Peptide Derived from Human Papillomavirus
SIQADTEAARA

SEQ ID NO: 36114 - protein, 9 aa, Artificial Sequence
  Peptide Derived from Human Papillomavirus
SLKVLIKQH

SEQ ID NO: 36115 - protein, 8 aa, Artificial Sequence
  Peptide Derived from Human Papillomavirus
SMENSIQA

SEQ ID NO: 36116 - protein, 10 aa, Artificial Sequence
  Peptide Derived from Human Papillomavirus
SSNTKANILY

SEQ ID NO: 36117 - protein, 11 aa, Artificial Sequence
  Peptide Derived from Human Papillomavirus
SSNTKANILYK

SEQ ID NO: 36118 - protein, 11 aa, Artificial Sequence
  Peptide Derived from Human Papillomavirus
SVAESLKVLIK

SEQ ID NO: 36119 - protein, 8 aa, Artificial Sequence
  Peptide Derived from Human Papillomavirus
TAFLGAFK

SEQ ID NO: 36120 - protein, 9 aa, Artificial Sequence
  Peptide Derived from Human Papillomavirus
TAFLGAFKK

SEQ ID NO: 36121 - protein, 10 aa, Artificial Sequence
  Peptide Derived from Human Papillomavirus
TAFLGAFKKF

SEQ ID NO: 36122 - protein, 8 aa, Artificial Sequence
  Peptide Derived from Human Papillomavirus
TCALYWFR

SEQ ID NO: 36123 - protein, 10 aa, Artificial Sequence
  Peptide Derived from Human Papillomavirus
TCALYWFRTA

SEQ ID NO: 36124 - protein, 9 aa, Artificial Sequence
  Peptide Derived from Human Papillomavirus
TCMVIEPPK

SEQ ID NO: 36125 - protein, 11 aa, Artificial Sequence
  Peptide Derived from Human Papillomavirus
TCMVIEPPKLR

SEQ ID NO: 36126 - protein, 8 aa, Artificial Sequence
  Peptide Derived from Human Papillomavirus
TDDSDIAY

SEQ ID NO: 36127 - protein, 9 aa, Artificial Sequence
  Peptide Derived from Human Papillomavirus
TDDSDIAYY

SEQ ID NO: 36128 - protein, 10 aa, Artificial Sequence
  Peptide Derived from Human Papillomavirus
TDDSDIAYYY

SEQ ID NO: 36129 - protein, 11 aa, Artificial Sequence
  Peptide Derived from Human Papillomavirus
TDDSDIAYYYA

SEQ ID NO: 36130 - protein, 9 aa, Artificial Sequence
  Peptide Derived from Human Papillomavirus
TDSRWPYLH

SEQ ID NO: 36131 - protein, 11 aa, Artificial Sequence
  Peptide Derived from Human Papillomavirus
TDSRWPYLHSR

SEQ ID NO: 36132 - protein, 8 aa, Artificial Sequence
  Peptide Derived from Human Papillomavirus
TDWCITGY

SEQ ID NO: 36133 - protein, 11 aa, Artificial Sequence
  Peptide Derived from Human Papillomavirus
TFKCSAGENTR

SEQ ID NO: 36134 - protein, 8 aa, Artificial Sequence
  Peptide Derived from Human Papillomavirus
TGWFEVEA

SEQ ID NO: 36135 - protein, 10 aa, Artificial Sequence
  Peptide Derived from Human Papillomavirus
TGYGISPSVA

SEQ ID NO: 36136 - protein, 10 aa, Artificial Sequence
  Peptide Derived from Human Papillomavirus
TLQEISNVLH

SEQ ID NO: 36137 - protein, 11 aa, Artificial Sequence
  Peptide Derived from Human Papillomavirus
TSCTDWCITGY

SEQ ID NO: 36138 - protein, 11 aa, Artificial Sequence
  Peptide Derived from Human Papillomavirus
TSINKNKECTY

SEQ ID NO: 36139 - protein, 11 aa, Artificial Sequence
  Peptide Derived from Human Papillomavirus
TSNTNAGTDSR

SEQ ID NO: 36140 - protein, 8 aa, Artificial Sequence
  Peptide Derived from Human Papillomavirus
TTPEWIDR

SEQ ID NO: 36141 - protein, 9 aa, Artificial Sequence
  Peptide Derived from Human Papillomavirus
TVFEFKNPF

SEQ ID NO: 36142 - protein, 11 aa, Artificial Sequence
  Peptide Derived from Human Papillomavirus
TVFEFKNPFPF

SEQ ID NO: 36143 - protein, 10 aa, Artificial Sequence
  Peptide Derived from Human Papillomavirus
VAESLKVLIK

SEQ ID NO: 36144 - protein, 8 aa, Artificial Sequence
  Peptide Derived from Human Papillomavirus
VCALKRKF

SEQ ID NO: 36145 - protein, 9 aa, Artificial Sequence
  Peptide Derived from Human Papillomavirus
VCALKRKFA

SEQ ID NO: 36146 - protein, 10 aa, Artificial Sequence
  Peptide Derived from Human Papillomavirus
VCALKRKFAA

SEQ ID NO: 36147 - protein, 9 aa, Artificial Sequence
  Peptide Derived from Human Papillomavirus
VDRAANPCR

SEQ ID NO: 36148 - protein, 8 aa, Artificial Sequence
  Peptide Derived from Human Papillomavirus
VFEFKNPF

SEQ ID NO: 36149 - protein, 10 aa, Artificial Sequence
  Peptide Derived from Human Papillomavirus
VFEFKNPFPF

SEQ ID NO: 36150 - protein, 8 aa, Artificial Sequence
  Peptide Derived from Human Papillomavirus
VIEPPKLR

SEQ ID NO: 36151 - protein, 8 aa, Artificial Sequence
  Peptide Derived from Human Papillomavirus
VISCVNSK

SEQ ID NO: 36152 - protein, 10 aa, Artificial Sequence
  Peptide Derived from Human Papillomavirus
VISCVNSKSH

SEQ ID NO: 36153 - protein, 11 aa, Artificial Sequence
  Peptide Derived from Human Papillomavirus
VISCVNSKSHF

SEQ ID NO: 36154 - protein, 8 aa, Artificial Sequence
  Peptide Derived from Human Papillomavirus
VLHSSNTK

SEQ ID NO: 36155 - protein, 9 aa, Artificial Sequence
  Peptide Derived from Human Papillomavirus
VLHSSNTKA

SEQ ID NO: 36156 - protein, 9 aa, Artificial Sequence
  Peptide Derived from Human Papillomavirus
VLIKQHSLY

SEQ ID NO: 36157 - protein, 11 aa, Artificial Sequence
  Peptide Derived from Human Papillomavirus
VLIKQHSLYTH

SEQ ID NO: 36158 - protein, 11 aa, Artificial Sequence
  Peptide Derived from Human Papillomavirus
VLQHSFNDNIF

SEQ ID NO: 36159 - protein, 11 aa, Artificial Sequence
  Peptide Derived from Human Papillomavirus
VTLQEISNVLH

SEQ ID NO: 36160 - protein, 8 aa, Artificial Sequence
  Peptide Derived from Human Papillomavirus
VTPISWTY

SEQ ID NO: 36161 - protein, 10 aa, Artificial Sequence
  Peptide Derived from Human Papillomavirus
VVDRAANPCR

SEQ ID NO: 36162 - protein, 10 aa, Artificial Sequence
  Peptide Derived from Human Papillomavirus
WFEVEAVIER

SEQ ID NO: 36163 - protein, 11 aa, Artificial Sequence
  Peptide Derived from Human Papillomavirus
WFEVEAVIERR

SEQ ID NO: 36164 - protein, 10 aa, Artificial Sequence
  Peptide Derived from Human Papillomavirus
WIDRLTVLQH

SEQ ID NO: 36165 - protein, 8 aa, Artificial Sequence
  Peptide Derived from Human Papillomavirus
WIQSRCEK

SEQ ID NO: 36166 - protein, 8 aa, Artificial Sequence
  Peptide Derived from Human Papillomavirus
WLQPLSDA

SEQ ID NO: 36167 - protein, 9 aa, Artificial Sequence
  Peptide Derived from Human Papillomavirus
WLQPLSDAK

SEQ ID NO: 36168 - protein, 9 aa, Artificial Sequence
  Peptide Derived from Human Papillomavirus
WTYIDDYMR

SEQ ID NO: 36169 - protein, 11 aa, Artificial Sequence
  Peptide Derived from Human Papillomavirus
WTYIDDYMRNA

SEQ ID NO: 36170 - protein, 9 aa, Artificial Sequence
  Peptide Derived from Human Papillomavirus
YAINDENWK

SEQ ID NO: 36171 - protein, 11 aa, Artificial Sequence
  Peptide Derived from Human Papillomavirus
YAINDENWKSF

SEQ ID NO: 36172 - protein, 11 aa, Artificial Sequence
  Peptide Derived from Human Papillomavirus
YAQLADSNSNA

SEQ ID NO: 36173 - protein, 9 aa, Artificial Sequence
  Peptide Derived from Human Papillomavirus
YFGMSLIQF

SEQ ID NO: 36174 - protein, 11 aa, Artificial Sequence
  Peptide Derived from Human Papillomavirus
YFGMSLIQFLK

SEQ ID NO: 36175 - protein, 10 aa, Artificial Sequence
  Peptide Derived from Human Papillomavirus
YGISFMELVR

SEQ ID NO: 36176 - protein, 8 aa, Artificial Sequence
  Peptide Derived from Human Papillomavirus
YGISPSVA

SEQ ID NO: 36177 - protein, 9 aa, Artificial Sequence
  Peptide Derived from Human Papillomavirus
YIDDYMRNA

SEQ ID NO: 36178 - protein, 9 aa, Artificial Sequence
  Peptide Derived from Human Papillomavirus
YLHSRLTVF

SEQ ID NO: 36179 - protein, 11 aa, Artificial Sequence
  Peptide Derived from Human Papillomavirus
YLHSRLTVFEF

SEQ ID NO: 36180 - protein, 11 aa, Artificial Sequence
  Peptide Derived from Human Papillomavirus
YTHLQCLTCDR

SEQ ID NO: 36181 - protein, 9 aa, Artificial Sequence
  Peptide Derived from Human Papillomavirus
AAAKRRRPA

SEQ ID NO: 36182 - protein, 8 aa, Artificial Sequence
  Peptide Derived from Human Papillomavirus
AAKRRRPA

SEQ ID NO: 36183 - protein, 10 aa, Artificial Sequence
  Peptide Derived from Human Papillomavirus
ADIQTDNDNR

SEQ ID NO: 36184 - protein, 8 aa, Artificial Sequence
  Peptide Derived from Human Papillomavirus
ADPALDNR

SEQ ID NO: 36185 - protein, 10 aa, Artificial Sequence
  Peptide Derived from Human Papillomavirus
ADPALDNRTA

SEQ ID NO: 36186 - protein, 11 aa, Artificial Sequence
  Peptide Derived from Human Papillomavirus
ADPALDNRTAR

SEQ ID NO: 36187 - protein, 10 aa, Artificial Sequence
  Peptide Derived from Human Papillomavirus
AFQVIELQMA

SEQ ID NO: 36188 - protein, 8 aa, Artificial Sequence
  Peptide Derived from Human Papillomavirus
ALDNRTAR

SEQ ID NO: 36189 - protein, 10 aa, Artificial Sequence
  Peptide Derived from Human Papillomavirus
ALDNRTARTA

SEQ ID NO: 36190 - protein, 10 aa, Artificial Sequence
  Peptide Derived from Human Papillomavirus
ALETLSKSQY

SEQ ID NO: 36191 - protein, 11 aa, Artificial Sequence
  Peptide Derived from Human Papillomavirus
ALLYTAKQMGF

SEQ ID NO: 36192 - protein, 9 aa, Artificial Sequence
  Peptide Derived from Human Papillomavirus
ATNCTNKQR

SEQ ID NO: 36193 - protein, 10 aa, Artificial Sequence
  Peptide Derived from Human Papillomavirus
AVQEKILDLY

SEQ ID NO: 36194 - protein, 9 aa, Artificial Sequence
  Peptide Derived from Human Papillomavirus
CADPALDNR

SEQ ID NO: 36195 - protein, 11 aa, Artificial Sequence
  Peptide Derived from Human Papillomavirus
CADPALDNRTA

SEQ ID NO: 36196 - protein, 8 aa, Artificial Sequence
  Peptide Derived from Human Papillomavirus
CALLYTAK

SEQ ID NO: 36197 - protein, 9 aa, Artificial Sequence
  Peptide Derived from Human Papillomavirus
CLRYRLKPY

SEQ ID NO: 36198 - protein, 10 aa, Artificial Sequence
  Peptide Derived from Human Papillomavirus
CLRYRLKPYK

SEQ ID NO: 36199 - protein, 10 aa, Artificial Sequence
  Peptide Derived from Human Papillomavirus
CSSNVAPIVH

SEQ ID NO: 36200 - protein, 10 aa, Artificial Sequence
  Peptide Derived from Human Papillomavirus
CTMVTGKVDY

SEQ ID NO: 36201 - protein, 9 aa, Artificial Sequence
  Peptide Derived from Human Papillomavirus
DIQTDNDNR

SEQ ID NO: 36202 - protein, 8 aa, Artificial Sequence
  Peptide Derived from Human Papillomavirus
DLPSQIEH

SEQ ID NO: 36203 - protein, 10 aa, Artificial Sequence
  Peptide Derived from Human Papillomavirus
DLPSQIEHWK

SEQ ID NO: 36204 - protein, 8 aa, Artificial Sequence
  Peptide Derived from Human Papillomavirus
DTAQPLTK

SEQ ID NO: 36205 - protein, 10 aa, Artificial Sequence
  Peptide Derived from Human Papillomavirus
DTAQPLTKLF

SEQ ID NO: 36206 - protein, 9 aa, Artificial Sequence
  Peptide Derived from Human Papillomavirus
DTCTMVTGK

SEQ ID NO: 36207 - protein, 11 aa, Artificial Sequence
  Peptide Derived from Human Papillomavirus
DTTDTAQPLTK

SEQ ID NO: 36208 - protein, 8 aa, Artificial Sequence
  Peptide Derived from Human Papillomavirus
ECALLYTA

SEQ ID NO: 36209 - protein, 9 aa, Artificial Sequence
  Peptide Derived from Human Papillomavirus
ECALLYTAK

SEQ ID NO: 36210 - protein, 8 aa, Artificial Sequence
  Peptide Derived from Human Papillomavirus
EDAAKYSK

SEQ ID NO: 36211 - protein, 10 aa, Artificial Sequence
  Peptide Derived from Human Papillomavirus
EDTCTMVTGK

SEQ ID NO: 36212 - protein, 8 aa, Artificial Sequence
  Peptide Derived from Human Papillomavirus
EISARLNA

SEQ ID NO: 36213 - protein, 11 aa, Artificial Sequence
  Peptide Derived from Human Papillomavirus
ELQMALETLSK

SEQ ID NO: 36214 - protein, 11 aa, Artificial Sequence
  Peptide Derived from Human Papillomavirus
ELYSSMSSTWH

SEQ ID NO: 36215 - protein, 9 aa, Artificial Sequence
  Peptide Derived from Human Papillomavirus
ESNSLKCLR

SEQ ID NO: 36216 - protein, 10 aa, Artificial Sequence
  Peptide Derived from Human Papillomavirus
ESNSLKCLRY

SEQ ID NO: 36217 - protein, 11 aa, Artificial Sequence
  Peptide Derived from Human Papillomavirus
ESNSLKCLRYR

SEQ ID NO: 36218 - protein, 8 aa, Artificial Sequence
  Peptide Derived from Human Papillomavirus
ETLSKSQY

SEQ ID NO: 36219 - protein, 11 aa, Artificial Sequence
  Peptide Derived from Human Papillomavirus
ETVTVQYDNDK

SEQ ID NO: 36220 - protein, 9 aa, Artificial Sequence
  Peptide Derived from Human Papillomavirus
EVWLCEPPK

SEQ ID NO: 36221 - protein, 11 aa, Artificial Sequence
  Peptide Derived from Human Papillomavirus
EVWLCEPPKCF

SEQ ID NO: 36222 - protein, 10 aa, Artificial Sequence
  Peptide Derived from Human Papillomavirus
FCADPALDNR

SEQ ID NO: 36223 - protein, 10 aa, Artificial Sequence
  Peptide Derived from Human Papillomavirus
FVTEQQQQMF

SEQ ID NO: 36224 - protein, 10 aa, Artificial Sequence
  Peptide Derived from Human Papillomavirus
GMYYIHNCEK

SEQ ID NO: 36225 - protein, 10 aa, Artificial Sequence
  Peptide Derived from Human Papillomavirus
HLKGESNSLK

SEQ ID NO: 36226 - protein, 11 aa, Artificial Sequence
  Peptide Derived from Human Papillomavirus
IGMYYIHNCEK

SEQ ID NO: 36227 - protein, 9 aa, Artificial Sequence
  Peptide Derived from Human Papillomavirus
ILDLYEADK

SEQ ID NO: 36228 - protein, 11 aa, Artificial Sequence
  Peptide Derived from Human Papillomavirus
ISARLNAVQEK

SEQ ID NO: 36229 - protein, 11 aa, Artificial Sequence
  Peptide Derived from Human Papillomavirus
KAFQVIELQMA

SEQ ID NO: 36230 - protein, 8 aa, Artificial Sequence
  Peptide Derived from Human Papillomavirus
KCLRYRLK

SEQ ID NO: 36231 - protein, 10 aa, Artificial Sequence
  Peptide Derived from Human Papillomavirus
KCLRYRLKPY

SEQ ID NO: 36232 - protein, 11 aa, Artificial Sequence
  Peptide Derived from Human Papillomavirus
KCLRYRLKPYK

SEQ ID NO: 36233 - protein, 8 aa, Artificial Sequence
  Peptide Derived from Human Papillomavirus
KGESNSLK

SEQ ID NO: 36234 - protein, 11 aa, Artificial Sequence
  Peptide Derived from Human Papillomavirus
KGESNSLKCLR

SEQ ID NO: 36235 - protein, 8 aa, Artificial Sequence
  Peptide Derived from Human Papillomavirus
KILDLYEA

SEQ ID NO: 36236 - protein, 10 aa, Artificial Sequence
  Peptide Derived from Human Papillomavirus
KILDLYEADK

SEQ ID NO: 36237 - protein, 8 aa, Artificial Sequence
  Peptide Derived from Human Papillomavirus
KLFCADPA

SEQ ID NO: 36238 - protein, 8 aa, Artificial Sequence
  Peptide Derived from Human Papillomavirus
KLIRMECA

SEQ ID NO: 36239 - protein, 11 aa, Artificial Sequence
  Peptide Derived from Human Papillomavirus
KLIRMECALLY

SEQ ID NO: 36240 - protein, 10 aa, Artificial Sequence
  Peptide Derived from Human Papillomavirus
KTDLPSQIEH

SEQ ID NO: 36241 - protein, 8 aa, Artificial Sequence
  Peptide Derived from Human Papillomavirus
KTQMWEVH

SEQ ID NO: 36242 - protein, 8 aa, Artificial Sequence
  Peptide Derived from Human Papillomavirus
KVDYIGMY

SEQ ID NO: 36243 - protein, 9 aa, Artificial Sequence
  Peptide Derived from Human Papillomavirus
KVDYIGMYY

SEQ ID NO: 36244 - protein, 11 aa, Artificial Sequence
  Peptide Derived from Human Papillomavirus
KVDYIGMYYIH

SEQ ID NO: 36245 - protein, 8 aa, Artificial Sequence
  Peptide Derived from Human Papillomavirus
KVYFKYFK

SEQ ID NO: 36246 - protein, 11 aa, Artificial Sequence
  Peptide Derived from Human Papillomavirus
KVYFKYFKEDA

SEQ ID NO: 36247 - protein, 8 aa, Artificial Sequence
  Peptide Derived from Human Papillomavirus
LASKTKAF

SEQ ID NO: 36248 - protein, 8 aa, Artificial Sequence
  Peptide Derived from Human Papillomavirus
LCEPPKCF

SEQ ID NO: 36249 - protein, 9 aa, Artificial Sequence
  Peptide Derived from Human Papillomavirus
LCEPPKCFK

SEQ ID NO: 36250 - protein, 10 aa, Artificial Sequence
  Peptide Derived from Human Papillomavirus
LCEPPKCFKK

SEQ ID NO: 36251 - protein, 11 aa, Artificial Sequence
  Peptide Derived from Human Papillomavirus
LCHQVVPSLLA

SEQ ID NO: 36252 - protein, 8 aa, Artificial Sequence
  Peptide Derived from Human Papillomavirus
LDLYEADK

SEQ ID NO: 36253 - protein, 9 aa, Artificial Sequence
  Peptide Derived from Human Papillomavirus
LDNRTARTA

SEQ ID NO: 36254 - protein, 11 aa, Artificial Sequence
  Peptide Derived from Human Papillomavirus
LFCADPALDNR

SEQ ID NO: 36255 - protein, 10 aa, Artificial Sequence
  Peptide Derived from Human Papillomavirus
LIRMECALLY

SEQ ID NO: 36256 - protein, 8 aa, Artificial Sequence
  Peptide Derived from Human Papillomavirus
LLASKTKA

SEQ ID NO: 36257 - protein, 9 aa, Artificial Sequence
  Peptide Derived from Human Papillomavirus
LLASKTKAF

SEQ ID NO: 36258 - protein, 10 aa, Artificial Sequence
  Peptide Derived from Human Papillomavirus
LLYTAKQMGF

SEQ ID NO: 36259 - protein, 10 aa, Artificial Sequence
  Peptide Derived from Human Papillomavirus
LTKLFCADPA

SEQ ID NO: 36260 - protein, 8 aa, Artificial Sequence
  Peptide Derived from Human Papillomavirus
MALETLSK

SEQ ID NO: 36261 - protein, 11 aa, Artificial Sequence
  Peptide Derived from Human Papillomavirus
MALETLSKSQY

SEQ ID NO: 36262 - protein, 10 aa, Artificial Sequence
  Peptide Derived from Human Papillomavirus
MDYTNWGEIY

SEQ ID NO: 36263 - protein, 8 aa, Artificial Sequence
  Peptide Derived from Human Papillomavirus
MGFSHLCH

SEQ ID NO: 36264 - protein, 8 aa, Artificial Sequence
  Peptide Derived from Human Papillomavirus
MVTGKVDY

SEQ ID NO: 36265 - protein, 11 aa, Artificial Sequence
  Peptide Derived from Human Papillomavirus
NAVQEKILDLY

SEQ ID NO: 36266 - protein, 8 aa, Artificial Sequence
  Peptide Derived from Human Papillomavirus
NCEKVYFK

SEQ ID NO: 36267 - protein, 9 aa, Artificial Sequence
  Peptide Derived from Human Papillomavirus
NCEKVYFKY

SEQ ID NO: 36268 - protein, 10 aa, Artificial Sequence
  Peptide Derived from Human Papillomavirus
NCEKVYFKYF

SEQ ID NO: 36269 - protein, 11 aa, Artificial Sequence
  Peptide Derived from Human Papillomavirus
NCEKVYFKYFK

SEQ ID NO: 36270 - protein, 9 aa, Artificial Sequence
  Peptide Derived from Human Papillomavirus
NDKKNTMDY

SEQ ID NO: 36271 - protein, 8 aa, Artificial Sequence
  Peptide Derived from Human Papillomavirus
NDNRPPQA

SEQ ID NO: 36272 - protein, 9 aa, Artificial Sequence
  Peptide Derived from Human Papillomavirus
NDNRPPQAA

SEQ ID NO: 36273 - protein, 10 aa, Artificial Sequence
  Peptide Derived from Human Papillomavirus
NDNRPPQAAA

SEQ ID NO: 36274 - protein, 11 aa, Artificial Sequence
  Peptide Derived from Human Papillomavirus
NDNRPPQAAAK

SEQ ID NO: 36275 - protein, 8 aa, Artificial Sequence
  Peptide Derived from Human Papillomavirus
NGIVTVTF

SEQ ID NO: 36276 - protein, 11 aa, Artificial Sequence
  Peptide Derived from Human Papillomavirus
NSKNGIVTVTF

SEQ ID NO: 36277 - protein, 8 aa, Artificial Sequence
  Peptide Derived from Human Papillomavirus
NSLKCLRY

SEQ ID NO: 36278 - protein, 9 aa, Artificial Sequence
  Peptide Derived from Human Papillomavirus
NSLKCLRYR

SEQ ID NO: 36279 - protein, 11 aa, Artificial Sequence
  Peptide Derived from Human Papillomavirus
NSLKCLRYRLK

SEQ ID NO: 36280 - protein, 9 aa, Artificial Sequence
  Peptide Derived from Human Papillomavirus
NVAPIVHLK

SEQ ID NO: 36281 - protein, 8 aa, Artificial Sequence
  Peptide Derived from Human Papillomavirus
PADTTDTA

SEQ ID NO: 36282 - protein, 8 aa, Artificial Sequence
  Peptide Derived from Human Papillomavirus
PALDNRTA

SEQ ID NO: 36283 - protein, 9 aa, Artificial Sequence
  Peptide Derived from Human Papillomavirus
PALDNRTAR

SEQ ID NO: 36284 - protein, 11 aa, Artificial Sequence
  Peptide Derived from Human Papillomavirus
PALDNRTARTA

SEQ ID NO: 36285 - protein, 8 aa, Artificial Sequence
  Peptide Derived from Human Papillomavirus
PLTKLFCA

SEQ ID NO: 36286 - protein, 11 aa, Artificial Sequence
  Peptide Derived from Human Papillomavirus
PLTKLFCADPA

SEQ ID NO: 36287 - protein, 9 aa, Artificial Sequence
  Peptide Derived from Human Papillomavirus
PSLLASKTK

SEQ ID NO: 36288 - protein, 10 aa, Artificial Sequence
  Peptide Derived from Human Papillomavirus
PSLLASKTKA

SEQ ID NO: 36289 - protein, 11 aa, Artificial Sequence
  Peptide Derived from Human Papillomavirus
PSLLASKTKAF

SEQ ID NO: 36290 - protein, 8 aa, Artificial Sequence
  Peptide Derived from Human Papillomavirus
PSQIEHWK

SEQ ID NO: 36291 - protein, 11 aa, Artificial Sequence
  Peptide Derived from Human Papillomavirus
PSQIEHWKLIR

SEQ ID NO: 36292 - protein, 9 aa, Artificial Sequence
  Peptide Derived from Human Papillomavirus
PTVQISTGF

SEQ ID NO: 36293 - protein, 8 aa, Artificial Sequence
  Peptide Derived from Human Papillomavirus
QAAAKRRR

SEQ ID NO: 36294 - protein, 10 aa, Artificial Sequence
  Peptide Derived from Human Papillomavirus
QAAAKRRRPA

SEQ ID NO: 36295 - protein, 9 aa, Artificial Sequence
  Peptide Derived from Human Papillomavirus
QGETVTVQY

SEQ ID NO: 36296 - protein, 9 aa, Artificial Sequence
  Peptide Derived from Human Papillomavirus
QIEHWKLIR

SEQ ID NO: 36297 - protein, 8 aa, Artificial Sequence
  Peptide Derived from Human Papillomavirus
QISTTETA

SEQ ID NO: 36298 - protein, 9 aa, Artificial Sequence
  Peptide Derived from Human Papillomavirus
QMALETLSK

SEQ ID NO: 36299 - protein, 8 aa, Artificial Sequence
  Peptide Derived from Human Papillomavirus
QMFLGTVK

SEQ ID NO: 36300 - protein, 9 aa, Artificial Sequence
  Peptide Derived from Human Papillomavirus
QMGFSHLCH

SEQ ID NO: 36301 - protein, 11 aa, Artificial Sequence
  Peptide Derived from Human Papillomavirus
QTDNDNRPPQA

SEQ ID NO: 36302 - protein, 8 aa, Artificial Sequence
  Peptide Derived from Human Papillomavirus
QVIELQMA

SEQ ID NO: 36303 - protein, 8 aa, Artificial Sequence
  Peptide Derived from Human Papillomavirus
QVVPSLLA

SEQ ID NO: 36304 - protein, 10 aa, Artificial Sequence
  Peptide Derived from Human Papillomavirus
QVVPSLLASK

SEQ ID NO: 36305 - protein, 9 aa, Artificial Sequence
  Peptide Derived from Human Papillomavirus
RLKPYKELY

SEQ ID NO: 36306 - protein, 8 aa, Artificial Sequence
  Peptide Derived from Human Papillomavirus
RLNAVQEK

SEQ ID NO: 36307 - protein, 8 aa, Artificial Sequence
  Peptide Derived from Human Papillomavirus
RMECALLY

SEQ ID NO: 36308 - protein, 10 aa, Artificial Sequence
  Peptide Derived from Human Papillomavirus
RMECALLYTA

SEQ ID NO: 36309 - protein, 11 aa, Artificial Sequence
  Peptide Derived from Human Papillomavirus
RMECALLYTAK

SEQ ID NO: 36310 - protein, 9 aa, Artificial Sequence
  Peptide Derived from Human Papillomavirus
RTATNCTNK

SEQ ID NO: 36311 - protein, 11 aa, Artificial Sequence
  Peptide Derived from Human Papillomavirus
RTATNCTNKQR

SEQ ID NO: 36312 - protein, 9 aa, Artificial Sequence
  Peptide Derived from Human Papillomavirus
RTVCSSNVA

SEQ ID NO: 36313 - protein, 10 aa, Artificial Sequence
  Peptide Derived from Human Papillomavirus
SARLNAVQEK

SEQ ID NO: 36314 - protein, 11 aa, Artificial Sequence
  Peptide Derived from Human Papillomavirus
SLEVWLCEPPK

SEQ ID NO: 36315 - protein, 8 aa, Artificial Sequence
  Peptide Derived from Human Papillomavirus
SLKCLRYR

SEQ ID NO: 36316 - protein, 10 aa, Artificial Sequence
  Peptide Derived from Human Papillomavirus
SLKCLRYRLK

SEQ ID NO: 36317 - protein, 8 aa, Artificial Sequence
  Peptide Derived from Human Papillomavirus
SLLASKTK

SEQ ID NO: 36318 - protein, 9 aa, Artificial Sequence
  Peptide Derived from Human Papillomavirus
SLLASKTKA

SEQ ID NO: 36319 - protein, 10 aa, Artificial Sequence
  Peptide Derived from Human Papillomavirus
SLLASKTKAF

SEQ ID NO: 36320 - protein, 8 aa, Artificial Sequence
  Peptide Derived from Human Papillomavirus
SSMSSTWH

SEQ ID NO: 36321 - protein, 11 aa, Artificial Sequence
  Peptide Derived from Human Papillomavirus
SSNQISTTETA

SEQ ID NO: 36322 - protein, 9 aa, Artificial Sequence
  Peptide Derived from Human Papillomavirus
SSNVAPIVH

SEQ ID NO: 36323 - protein, 11 aa, Artificial Sequence
  Peptide Derived from Human Papillomavirus
SSNVAPIVHLK

SEQ ID NO: 36324 - protein, 11 aa, Artificial Sequence
  Peptide Derived from Human Papillomavirus
SSTWHWTSDNK

SEQ ID NO: 36325 - protein, 10 aa, Artificial Sequence
  Peptide Derived from Human Papillomavirus
STWHWTSDNK

SEQ ID NO: 36326 - protein, 11 aa, Artificial Sequence
  Peptide Derived from Human Papillomavirus
TADIQTDNDNR

SEQ ID NO: 36327 - protein, 9 aa, Artificial Sequence
  Peptide Derived from Human Papillomavirus
TAKQMGFSH

SEQ ID NO: 36328 - protein, 9 aa, Artificial Sequence
  Peptide Derived from Human Papillomavirus
TAQPLTKLF

SEQ ID NO: 36329 - protein, 11 aa, Artificial Sequence
  Peptide Derived from Human Papillomavirus
TAQPLTKLFCA

SEQ ID NO: 36330 - protein, 11 aa, Artificial Sequence
  Peptide Derived from Human Papillomavirus
TARTATNCTNK

SEQ ID NO: 36331 - protein, 8 aa, Artificial Sequence
  Peptide Derived from Human Papillomavirus
TATNCTNK

SEQ ID NO: 36332 - protein, 10 aa, Artificial Sequence
  Peptide Derived from Human Papillomavirus
TATNCTNKQR

SEQ ID NO: 36333 - protein, 8 aa, Artificial Sequence
  Peptide Derived from Human Papillomavirus
TCTMVTGK

SEQ ID NO: 36334 - protein, 11 aa, Artificial Sequence
  Peptide Derived from Human Papillomavirus
TCTMVTGKVDY

SEQ ID NO: 36335 - protein, 9 aa, Artificial Sequence
  Peptide Derived from Human Papillomavirus
TDLPSQIEH

SEQ ID NO: 36336 - protein, 11 aa, Artificial Sequence
  Peptide Derived from Human Papillomavirus
TDLPSQIEHWK

SEQ ID NO: 36337 - protein, 10 aa, Artificial Sequence
  Peptide Derived from Human Papillomavirus
TDNDNRPPQA

SEQ ID NO: 36338 - protein, 11 aa, Artificial Sequence
  Peptide Derived from Human Papillomavirus
TDNDNRPPQAA

SEQ ID NO: 36339 - protein, 9 aa, Artificial Sequence
  Peptide Derived from Human Papillomavirus
TDTAQPLTK

SEQ ID NO: 36340 - protein, 11 aa, Artificial Sequence
  Peptide Derived from Human Papillomavirus
TDTAQPLTKLF

SEQ ID NO: 36341 - protein, 11 aa, Artificial Sequence
  Peptide Derived from Human Papillomavirus
TFVTEQQQQMF

SEQ ID NO: 36342 - protein, 10 aa, Artificial Sequence
  Peptide Derived from Human Papillomavirus
TGKVDYIGMY

SEQ ID NO: 36343 - protein, 11 aa, Artificial Sequence
  Peptide Derived from Human Papillomavirus
TGKVDYIGMYY

SEQ ID NO: 36344 - protein, 11 aa, Artificial Sequence
  Peptide Derived from Human Papillomavirus
TMDYTNWGEIY

SEQ ID NO: 36345 - protein, 9 aa, Artificial Sequence
  Peptide Derived from Human Papillomavirus
TMVTGKVDY

SEQ ID NO: 36346 - protein, 8 aa, Artificial Sequence
  Peptide Derived from Human Papillomavirus
TSDNKNSK

SEQ ID NO: 36347 - protein, 10 aa, Artificial Sequence
  Peptide Derived from Human Papillomavirus
TTDTAQPLTK

SEQ ID NO: 36348 - protein, 8 aa, Artificial Sequence
  Peptide Derived from Human Papillomavirus
TVCSSNVA

SEQ ID NO: 36349 - protein, 8 aa, Artificial Sequence
  Peptide Derived from Human Papillomavirus
TVQISTGF

SEQ ID NO: 36350 - protein, 8 aa, Artificial Sequence
  Peptide Derived from Human Papillomavirus
TVQYDNDK

SEQ ID NO: 36351 - protein, 9 aa, Artificial Sequence
  Peptide Derived from Human Papillomavirus
TVQYDNDKK

SEQ ID NO: 36352 - protein, 10 aa, Artificial Sequence
  Peptide Derived from Human Papillomavirus
TVTVQYDNDK

SEQ ID NO: 36353 - protein, 11 aa, Artificial Sequence
  Peptide Derived from Human Papillomavirus
TVTVQYDNDKK

SEQ ID NO: 36354 - protein, 8 aa, Artificial Sequence
  Peptide Derived from Human Papillomavirus
VAPIVHLK

SEQ ID NO: 36355 - protein, 11 aa, Artificial Sequence
  Peptide Derived from Human Papillomavirus
VCSSNVAPIVH

SEQ ID NO: 36356 - protein, 8 aa, Artificial Sequence
  Peptide Derived from Human Papillomavirus
VDYIGMYY

SEQ ID NO: 36357 - protein, 10 aa, Artificial Sequence
  Peptide Derived from Human Papillomavirus
VDYIGMYYIH

SEQ ID NO: 36358 - protein, 9 aa, Artificial Sequence
  Peptide Derived from Human Papillomavirus
VTEQQQQMF

SEQ ID NO: 36359 - protein, 11 aa, Artificial Sequence
  Peptide Derived from Human Papillomavirus
VTGKVDYIGMY

SEQ ID NO: 36360 - protein, 9 aa, Artificial Sequence
  Peptide Derived from Human Papillomavirus
VTVQYDNDK

SEQ ID NO: 36361 - protein, 10 aa, Artificial Sequence
  Peptide Derived from Human Papillomavirus
VTVQYDNDKK

SEQ ID NO: 36362 - protein, 9 aa, Artificial Sequence
  Peptide Derived from Human Papillomavirus
VVPSLLASK

SEQ ID NO: 36363 - protein, 11 aa, Artificial Sequence
  Peptide Derived from Human Papillomavirus
VVPSLLASKTK

SEQ ID NO: 36364 - protein, 9 aa, Artificial Sequence
  Peptide Derived from Human Papillomavirus
WLCEPPKCF

SEQ ID NO: 36365 - protein, 10 aa, Artificial Sequence
  Peptide Derived from Human Papillomavirus
WLCEPPKCFK

SEQ ID NO: 36366 - protein, 11 aa, Artificial Sequence
  Peptide Derived from Human Papillomavirus
WLCEPPKCFKK

SEQ ID NO: 36367 - protein, 9 aa, Artificial Sequence
  Peptide Derived from Human Papillomavirus
WTSDNKNSK

SEQ ID NO: 36368 - protein, 11 aa, Artificial Sequence
  Peptide Derived from Human Papillomavirus
YDNDKKNTMDY

SEQ ID NO: 36369 - protein, 8 aa, Artificial Sequence
  Peptide Derived from Human Papillomavirus
YFKEDAAK

SEQ ID NO: 36370 - protein, 9 aa, Artificial Sequence
  Peptide Derived from Human Papillomavirus
YFKEDAAKY

SEQ ID NO: 36371 - protein, 11 aa, Artificial Sequence
  Peptide Derived from Human Papillomavirus
YFKEDAAKYSK

SEQ ID NO: 36372 - protein, 9 aa, Artificial Sequence
  Peptide Derived from Human Papillomavirus
YFKYFKEDA

SEQ ID NO: 36373 - protein, 10 aa, Artificial Sequence
  Peptide Derived from Human Papillomavirus
YFKYFKEDAA

SEQ ID NO: 36374 - protein, 11 aa, Artificial Sequence
  Peptide Derived from Human Papillomavirus
YFKYFKEDAAK

SEQ ID NO: 36375 - protein, 8 aa, Artificial Sequence
  Peptide Derived from Human Papillomavirus
YIGMYYIH

SEQ ID NO: 36376 - protein, 9 aa, Artificial Sequence
  Peptide Derived from Human Papillomavirus
YIHNCEKVY

SEQ ID NO: 36377 - protein, 10 aa, Artificial Sequence
  Peptide Derived from Human Papillomavirus
YIHNCEKVYF

SEQ ID NO: 36378 - protein, 11 aa, Artificial Sequence
  Peptide Derived from Human Papillomavirus
YIHNCEKVYFK

SEQ ID NO: 36379 - protein, 10 aa, Artificial Sequence
  Peptide Derived from Human Papillomavirus
YSKTQMWEVH

SEQ ID NO: 36380 - protein, 9 aa, Artificial Sequence
  Peptide Derived from Human Papillomavirus
YSSMSSTWH

SEQ ID NO: 36381 - protein, 8 aa, Artificial Sequence
  Peptide Derived from Human Papillomavirus
YTAKQMGF

SEQ ID NO: 36382 - protein, 10 aa, Artificial Sequence
  Peptide Derived from Human Papillomavirus
YTAKQMGFSH

SEQ ID NO: 36383 - protein, 8 aa, Artificial Sequence
  Peptide Derived from Human Papillomavirus
YTNWGEIY

SEQ ID NO: 36384 - protein, 8 aa, Artificial Sequence
  Peptide Derived from Human Papillomavirus
CINFHAQH

SEQ ID NO: 36385 - protein, 8 aa, Artificial Sequence
  Peptide Derived from Human Papillomavirus
FCYLLFLY

SEQ ID NO: 36386 - protein, 9 aa, Artificial Sequence
  Peptide Derived from Human Papillomavirus
FFCYLLFLY

SEQ ID NO: 36387 - protein, 9 aa, Artificial Sequence
  Peptide Derived from Human Papillomavirus
FLCLSLLLR

SEQ ID NO: 36388 - protein, 11 aa, Artificial Sequence
  Peptide Derived from Human Papillomavirus
FLYLPMMCINF

SEQ ID NO: 36389 - protein, 10 aa, Artificial Sequence
  Peptide Derived from Human Papillomavirus
FVFVLCFILF

SEQ ID NO: 36390 - protein, 9 aa, Artificial Sequence
  Peptide Derived from Human Papillomavirus
FVGSPLKIF

SEQ ID NO: 36391 - protein, 10 aa, Artificial Sequence
  Peptide Derived from Human Papillomavirus
FVGSPLKIFF

SEQ ID NO: 36392 - protein, 8 aa, Artificial Sequence
  Peptide Derived from Human Papillomavirus
FVLCFILF

SEQ ID NO: 36393 - protein, 8 aa, Artificial Sequence
  Peptide Derived from Human Papillomavirus
GSPLKIFF

SEQ ID NO: 36394 - protein, 10 aa, Artificial Sequence
  Peptide Derived from Human Papillomavirus
GSPLKIFFCY

SEQ ID NO: 36395 - protein, 8 aa, Artificial Sequence
  Peptide Derived from Human Papillomavirus
IFFCYLLF

SEQ ID NO: 36396 - protein, 10 aa, Artificial Sequence
  Peptide Derived from Human Papillomavirus
IFFCYLLFLY

SEQ ID NO: 36397 - protein, 8 aa, Artificial Sequence
  Peptide Derived from Human Papillomavirus
IFVFVLCF

SEQ ID NO: 36398 - protein, 11 aa, Artificial Sequence
  Peptide Derived from Human Papillomavirus
IFVFVLCFILF

SEQ ID NO: 36399 - protein, 11 aa, Artificial Sequence
  Peptide Derived from Human Papillomavirus
ILFLCLSLLLR

SEQ ID NO: 36400 - protein, 8 aa, Artificial Sequence
  Peptide Derived from Human Papillomavirus
ILSISTYA

SEQ ID NO: 36401 - protein, 9 aa, Artificial Sequence
  Peptide Derived from Human Papillomavirus
KIFFCYLLF

SEQ ID NO: 36402 - protein, 11 aa, Artificial Sequence
  Peptide Derived from Human Papillomavirus
KIFFCYLLFLY

SEQ ID NO: 36403 - protein, 8 aa, Artificial Sequence
  Peptide Derived from Human Papillomavirus
LCLSLLLR

SEQ ID NO: 36404 - protein, 10 aa, Artificial Sequence
  Peptide Derived from Human Papillomavirus
LFLCLSLLLR

SEQ ID NO: 36405 - protein, 8 aa, Artificial Sequence
  Peptide Derived from Human Papillomavirus
LILSISTY

SEQ ID NO: 36406 - protein, 9 aa, Artificial Sequence
  Peptide Derived from Human Papillomavirus
LILSISTYA

SEQ ID NO: 36407 - protein, 11 aa, Artificial Sequence
  Peptide Derived from Human Papillomavirus
LLVLVLLLWVF

SEQ ID NO: 36408 - protein, 11 aa, Artificial Sequence
  Peptide Derived from Human Papillomavirus
LLWVFVGSPLK

SEQ ID NO: 36409 - protein, 8 aa, Artificial Sequence
  Peptide Derived from Human Papillomavirus
LVLLLWVF

SEQ ID NO: 36410 - protein, 10 aa, Artificial Sequence
  Peptide Derived from Human Papillomavirus
LVLVLLLWVF

SEQ ID NO: 36411 - protein, 9 aa, Artificial Sequence
  Peptide Derived from Human Papillomavirus
MCINFHAQH

SEQ ID NO: 36412 - protein, 9 aa, Artificial Sequence
  Peptide Derived from Human Papillomavirus
MIFVFVLCF

SEQ ID NO: 36413 - protein, 8 aa, Artificial Sequence
  Peptide Derived from Human Papillomavirus
MMCINFHA

SEQ ID NO: 36414 - protein, 10 aa, Artificial Sequence
  Peptide Derived from Human Papillomavirus
MMCINFHAQH

SEQ ID NO: 36415 - protein, 9 aa, Artificial Sequence
  Peptide Derived from Human Papillomavirus
PLILSISTY

SEQ ID NO: 36416 - protein, 10 aa, Artificial Sequence
  Peptide Derived from Human Papillomavirus
PLILSISTYA

SEQ ID NO: 36417 - protein, 8 aa, Artificial Sequence
  Peptide Derived from Human Papillomavirus
PLKIFFCY

SEQ ID NO: 36418 - protein, 11 aa, Artificial Sequence
  Peptide Derived from Human Papillomavirus
PLKIFFCYLLF

SEQ ID NO: 36419 - protein, 8 aa, Artificial Sequence
  Peptide Derived from Human Papillomavirus
PMMCINFH

SEQ ID NO: 36420 - protein, 9 aa, Artificial Sequence
  Peptide Derived from Human Papillomavirus
PMMCINFHA

SEQ ID NO: 36421 - protein, 11 aa, Artificial Sequence
  Peptide Derived from Human Papillomavirus
PMMCINFHAQH

SEQ ID NO: 36422 - protein, 8 aa, Artificial Sequence
  Peptide Derived from Human Papillomavirus
VFVGSPLK

SEQ ID NO: 36423 - protein, 10 aa, Artificial Sequence
  Peptide Derived from Human Papillomavirus
VFVGSPLKIF

SEQ ID NO: 36424 - protein, 11 aa, Artificial Sequence
  Peptide Derived from Human Papillomavirus
VFVGSPLKIFF

SEQ ID NO: 36425 - protein, 9 aa, Artificial Sequence
  Peptide Derived from Human Papillomavirus
VFVLCFILF

SEQ ID NO: 36426 - protein, 8 aa, Artificial Sequence
  Peptide Derived from Human Papillomavirus
VGSPLKIF

SEQ ID NO: 36427 - protein, 9 aa, Artificial Sequence
  Peptide Derived from Human Papillomavirus
VGSPLKIFF

SEQ ID NO: 36428 - protein, 11 aa, Artificial Sequence
  Peptide Derived from Human Papillomavirus
VGSPLKIFFCY

SEQ ID NO: 36429 - protein, 9 aa, Artificial Sequence
  Peptide Derived from Human Papillomavirus
VLVLLLWVF

SEQ ID NO: 36430 - protein, 9 aa, Artificial Sequence
  Peptide Derived from Human Papillomavirus
WVFVGSPLK

SEQ ID NO: 36431 - protein, 11 aa, Artificial Sequence
  Peptide Derived from Human Papillomavirus
WVFVGSPLKIF

SEQ ID NO: 36432 - protein, 9 aa, Artificial Sequence
  Peptide Derived from Human Papillomavirus
YLPMMCINF

SEQ ID NO: 36433 - protein, 10 aa, Artificial Sequence
  Peptide Derived from Human Papillomavirus
YLPMMCINFH

SEQ ID NO: 36434 - protein, 11 aa, Artificial Sequence
  Peptide Derived from Human Papillomavirus
YLPMMCINFHA

SEQ ID NO: 36435 - protein, 8 aa, Artificial Sequence
  Peptide Derived from Human Papillomavirus
AACWRSRR

SEQ ID NO: 36436 - protein, 9 aa, Artificial Sequence
  Peptide Derived from Human Papillomavirus
AACWRSRRR

SEQ ID NO: 36437 - protein, 8 aa, Artificial Sequence
  Peptide Derived from Human Papillomavirus
ACWRSRRR

SEQ ID NO: 36438 - protein, 11 aa, Artificial Sequence
  Peptide Derived from Human Papillomavirus
ACWRSRRRETA

SEQ ID NO: 36439 - protein, 8 aa, Artificial Sequence
  Peptide Derived from Human Papillomavirus
ADLTVVYR

SEQ ID NO: 36440 - protein, 9 aa, Artificial Sequence
  Peptide Derived from Human Papillomavirus
AFADLTVVY

SEQ ID NO: 36441 - protein, 10 aa, Artificial Sequence
  Peptide Derived from Human Papillomavirus
AFADLTVVYR

SEQ ID NO: 36442 - protein, 9 aa, Artificial Sequence
  Peptide Derived from Human Papillomavirus
AGRCAACWR

SEQ ID NO: 36443 - protein, 11 aa, Artificial Sequence
  Peptide Derived from Human Papillomavirus
AGRCAACWRSR

SEQ ID NO: 36444 - protein, 8 aa, Artificial Sequence
  Peptide Derived from Human Papillomavirus
CAACWRSR

SEQ ID NO: 36445 - protein, 9 aa, Artificial Sequence
  Peptide Derived from Human Papillomavirus
CAACWRSRR

SEQ ID NO: 36446 - protein, 10 aa, Artificial Sequence
  Peptide Derived from Human Papillomavirus
CAACWRSRRR

SEQ ID NO: 36447 - protein, 11 aa, Artificial Sequence
  Peptide Derived from Human Papillomavirus
CLRFLSKISEY

SEQ ID NO: 36448 - protein, 10 aa, Artificial Sequence
  Peptide Derived from Human Papillomavirus
CVECKKPLQR

SEQ ID NO: 36449 - protein, 11 aa, Artificial Sequence
  Peptide Derived from Human Papillomavirus
DFAFADLTVVY

SEQ ID NO: 36450 - protein, 11 aa, Artificial Sequence
  Peptide Derived from Human Papillomavirus
DLCQALETTIH

SEQ ID NO: 36451 - protein, 10 aa, Artificial Sequence
  Peptide Derived from Human Papillomavirus
DTEEKPRTLH

SEQ ID NO: 36452 - protein, 8 aa, Artificial Sequence
  Peptide Derived from Human Papillomavirus
ECKKPLQR

SEQ ID NO: 36453 - protein, 9 aa, Artificial Sequence
  Peptide Derived from Human Papillomavirus
EGNPFGICK

SEQ ID NO: 36454 - protein, 11 aa, Artificial Sequence
  Peptide Derived from Human Papillomavirus
EILIRCIICQR

SEQ ID NO: 36455 - protein, 8 aa, Artificial Sequence
  Peptide Derived from Human Papillomavirus
ELQCVECK

SEQ ID NO: 36456 - protein, 9 aa, Artificial Sequence
  Peptide Derived from Human Papillomavirus
ELQCVECKK

SEQ ID NO: 36457 - protein, 8 aa, Artificial Sequence
  Peptide Derived from Human Papillomavirus
EVYDFAFA

SEQ ID NO: 36458 - protein, 8 aa, Artificial Sequence
  Peptide Derived from Human Papillomavirus
FADLTVVY

SEQ ID NO: 36459 - protein, 9 aa, Artificial Sequence
  Peptide Derived from Human Papillomavirus
FADLTVVYR

SEQ ID NO: 36460 - protein, 10 aa, Artificial Sequence
  Peptide Derived from Human Papillomavirus
FAFADLTVVY

SEQ ID NO: 36461 - protein, 11 aa, Artificial Sequence
  Peptide Derived from Human Papillomavirus
FAFADLTVVYR

SEQ ID NO: 36462 - protein, 9 aa, Artificial Sequence
  Peptide Derived from Human Papillomavirus
FGICKLCLR

SEQ ID NO: 36463 - protein, 10 aa, Artificial Sequence
  Peptide Derived from Human Papillomavirus
FGICKLCLRF

SEQ ID NO: 36464 - protein, 8 aa, Artificial Sequence
  Peptide Derived from Human Papillomavirus
FLSKISEY

SEQ ID NO: 36465 - protein, 9 aa, Artificial Sequence
  Peptide Derived from Human Papillomavirus
FLSKISEYR

SEQ ID NO: 36466 - protein, 10 aa, Artificial Sequence
  Peptide Derived from Human Papillomavirus
FLSKISEYRH

SEQ ID NO: 36467 - protein, 11 aa, Artificial Sequence
  Peptide Derived from Human Papillomavirus
FLSKISEYRHY

SEQ ID NO: 36468 - protein, 8 aa, Artificial Sequence
  Peptide Derived from Human Papillomavirus
GICKLCLR

SEQ ID NO: 36469 - protein, 9 aa, Artificial Sequence
  Peptide Derived from Human Papillomavirus
GICKLCLRF

SEQ ID NO: 36470 - protein, 8 aa, Artificial Sequence
  Peptide Derived from Human Papillomavirus
HVDLNKRF

SEQ ID NO: 36471 - protein, 9 aa, Artificial Sequence
  Peptide Derived from Human Papillomavirus
HVDLNKRFH

SEQ ID NO: 36472 - protein, 8 aa, Artificial Sequence
  Peptide Derived from Human Papillomavirus
ICKLCLRF

SEQ ID NO: 36473 - protein, 11 aa, Artificial Sequence
  Peptide Derived from Human Papillomavirus
ICKLCLRFLSK

SEQ ID NO: 36474 - protein, 11 aa, Artificial Sequence
  Peptide Derived from Human Papillomavirus
ICQRPLCPQEK

SEQ ID NO: 36475 - protein, 10 aa, Artificial Sequence
  Peptide Derived from Human Papillomavirus
ILIRCIICQR

SEQ ID NO: 36476 - protein, 9 aa, Artificial Sequence
  Peptide Derived from Human Papillomavirus
ISEYRHYNY

SEQ ID NO: 36477 - protein, 8 aa, Artificial Sequence
  Peptide Derived from Human Papillomavirus
ISGRWAGR

SEQ ID NO: 36478 - protein, 10 aa, Artificial Sequence
  Peptide Derived from Human Papillomavirus
ISGRWAGRCA

SEQ ID NO: 36479 - protein, 11 aa, Artificial Sequence
  Peptide Derived from Human Papillomavirus
ISGRWAGRCAA

SEQ ID NO: 36480 - protein, 8 aa, Artificial Sequence
  Peptide Derived from Human Papillomavirus
KISEYRHY

SEQ ID NO: 36481 - protein, 10 aa, Artificial Sequence
  Peptide Derived from Human Papillomavirus
KISEYRHYNY

SEQ ID NO: 36482 - protein, 9 aa, Artificial Sequence
  Peptide Derived from Human Papillomavirus
KLCLRFLSK

SEQ ID NO: 36483 - protein, 8 aa, Artificial Sequence
  Peptide Derived from Human Papillomavirus
LCLRFLSK

SEQ ID NO: 36484 - protein, 8 aa, Artificial Sequence
  Peptide Derived from Human Papillomavirus
LCPQEKKR

SEQ ID NO: 36485 - protein, 9 aa, Artificial Sequence
  Peptide Derived from Human Papillomavirus
LCPQEKKRH

SEQ ID NO: 36486 - protein, 10 aa, Artificial Sequence
  Peptide Derived from Human Papillomavirus
LCQALETTIH

SEQ ID NO: 36487 - protein, 9 aa, Artificial Sequence
  Peptide Derived from Human Papillomavirus
LIRCIICQR

SEQ ID NO: 36488 - protein, 8 aa, Artificial Sequence
  Peptide Derived from Human Papillomavirus
LSKISEYR

SEQ ID NO: 36489 - protein, 9 aa, Artificial Sequence
  Peptide Derived from Human Papillomavirus
LSKISEYRH

SEQ ID NO: 36490 - protein, 10 aa, Artificial Sequence
  Peptide Derived from Human Papillomavirus
LSKISEYRHY

SEQ ID NO: 36491 - protein, 11 aa, Artificial Sequence
  Peptide Derived from Human Papillomavirus
LTVVYREGNPF

SEQ ID NO: 36492 - protein, 8 aa, Artificial Sequence
  Peptide Derived from Human Papillomavirus
MFQDTEEK

SEQ ID NO: 36493 - protein, 10 aa, Artificial Sequence
  Peptide Derived from Human Papillomavirus
MFQDTEEKPR

SEQ ID NO: 36494 - protein, 10 aa, Artificial Sequence
  Peptide Derived from Human Papillomavirus
NIELQCVECK

SEQ ID NO: 36495 - protein, 11 aa, Artificial Sequence
  Peptide Derived from Human Papillomavirus
NIELQCVECKK

SEQ ID NO: 36496 - protein, 9 aa, Artificial Sequence
  Peptide Derived from Human Papillomavirus
NISGRWAGR

SEQ ID NO: 36497 - protein, 11 aa, Artificial Sequence
  Peptide Derived from Human Papillomavirus
NISGRWAGRCA

SEQ ID NO: 36498 - protein, 8 aa, Artificial Sequence
  Peptide Derived from Human Papillomavirus
NTLEQTVK

SEQ ID NO: 36499 - protein, 9 aa, Artificial Sequence
  Peptide Derived from Human Papillomavirus
NTLEQTVKK

SEQ ID NO: 36500 - protein, 10 aa, Artificial Sequence
  Peptide Derived from Human Papillomavirus
PFGICKLCLR

SEQ ID NO: 36501 - protein, 11 aa, Artificial Sequence
  Peptide Derived from Human Papillomavirus
PFGICKLCLRF

SEQ ID NO: 36502 - protein, 8 aa, Artificial Sequence
  Peptide Derived from Human Papillomavirus
PLCPQEKK

SEQ ID NO: 36503 - protein, 9 aa, Artificial Sequence
  Peptide Derived from Human Papillomavirus
PLCPQEKKR

SEQ ID NO: 36504 - protein, 10 aa, Artificial Sequence
  Peptide Derived from Human Papillomavirus
PLCPQEKKRH

SEQ ID NO: 36505 - protein, 8 aa, Artificial Sequence
  Peptide Derived from Human Papillomavirus
PLNEILIR

SEQ ID NO: 36506 - protein, 8 aa, Artificial Sequence
  Peptide Derived from Human Papillomavirus
PLQRSEVY

SEQ ID NO: 36507 - protein, 10 aa, Artificial Sequence
  Peptide Derived from Human Papillomavirus
PLQRSEVYDF

SEQ ID NO: 36508 - protein, 11 aa, Artificial Sequence
  Peptide Derived from Human Papillomavirus
PLQRSEVYDFA

SEQ ID NO: 36509 - protein, 8 aa, Artificial Sequence
  Peptide Derived from Human Papillomavirus
QALETTIH

SEQ ID NO: 36510 - protein, 11 aa, Artificial Sequence
  Peptide Derived from Human Papillomavirus
QCVECKKPLQR

SEQ ID NO: 36511 - protein, 8 aa, Artificial Sequence
  Peptide Derived from Human Papillomavirus
QDTEEKPR

SEQ ID NO: 36512 - protein, 11 aa, Artificial Sequence
  Peptide Derived from Human Papillomavirus
QDTEEKPRTLH

SEQ ID NO: 36513 - protein, 9 aa, Artificial Sequence
  Peptide Derived from Human Papillomavirus
RCAACWRSR

SEQ ID NO: 36514 - protein, 10 aa, Artificial Sequence
  Peptide Derived from Human Papillomavirus
RCAACWRSRR

SEQ ID NO: 36515 - protein, 11 aa, Artificial Sequence
  Peptide Derived from Human Papillomavirus
RCAACWRSRRR

SEQ ID NO: 36516 - protein, 8 aa, Artificial Sequence
  Peptide Derived from Human Papillomavirus
RFHNISGR

SEQ ID NO: 36517 - protein, 10 aa, Artificial Sequence
  Peptide Derived from Human Papillomavirus
RFHNISGRWA

SEQ ID NO: 36518 - protein, 9 aa, Artificial Sequence
  Peptide Derived from Human Papillomavirus
RFLSKISEY

SEQ ID NO: 36519 - protein, 10 aa, Artificial Sequence
  Peptide Derived from Human Papillomavirus
RFLSKISEYR

SEQ ID NO: 36520 - protein, 11 aa, Artificial Sequence
  Peptide Derived from Human Papillomavirus
RFLSKISEYRH

SEQ ID NO: 36521 - protein, 8 aa, Artificial Sequence
  Peptide Derived from Human Papillomavirus
RSEVYDFA

SEQ ID NO: 36522 - protein, 9 aa, Artificial Sequence
  Peptide Derived from Human Papillomavirus
RSEVYDFAF

SEQ ID NO: 36523 - protein, 10 aa, Artificial Sequence
  Peptide Derived from Human Papillomavirus
RSEVYDFAFA

SEQ ID NO: 36524 - protein, 8 aa, Artificial Sequence
  Peptide Derived from Human Papillomavirus
RSRRRETA

SEQ ID NO: 36525 - protein, 9 aa, Artificial Sequence
  Peptide Derived from Human Papillomavirus
RTLHDLCQA

SEQ ID NO: 36526 - protein, 9 aa, Artificial Sequence
  Peptide Derived from Human Papillomavirus
SGRWAGRCA

SEQ ID NO: 36527 - protein, 10 aa, Artificial Sequence
  Peptide Derived from Human Papillomavirus
SGRWAGRCAA

SEQ ID NO: 36528 - protein, 8 aa, Artificial Sequence
  Peptide Derived from Human Papillomavirus
TLEQTVKK

SEQ ID NO: 36529 - protein, 8 aa, Artificial Sequence
  Peptide Derived from Human Papillomavirus
TLHDLCQA

SEQ ID NO: 36530 - protein, 10 aa, Artificial Sequence
  Peptide Derived from Human Papillomavirus
TVVYREGNPF

SEQ ID NO: 36531 - protein, 8 aa, Artificial Sequence
  Peptide Derived from Human Papillomavirus
VDLNKRFH

SEQ ID NO: 36532 - protein, 9 aa, Artificial Sequence
  Peptide Derived from Human Papillomavirus
VVYREGNPF

SEQ ID NO: 36533 - protein, 10 aa, Artificial Sequence
  Peptide Derived from Human Papillomavirus
WAGRCAACWR

SEQ ID NO: 36534 - protein, 10 aa, Artificial Sequence
  Peptide Derived from Human Papillomavirus
YGNTLEQTVK

SEQ ID NO: 36535 - protein, 11 aa, Artificial Sequence
  Peptide Derived from Human Papillomavirus
YGNTLEQTVKK

SEQ ID NO: 36536 - protein, 10 aa, Artificial Sequence
  Peptide Derived from Human Papillomavirus
ADYYIVTCCH

SEQ ID NO: 36537 - protein, 10 aa, Artificial Sequence
  Peptide Derived from Human Papillomavirus
CCHTCNTTVR

SEQ ID NO: 36538 - protein, 10 aa, Artificial Sequence
  Peptide Derived from Human Papillomavirus
CVNSTASDLR

SEQ ID NO: 36539 - protein, 9 aa, Artificial Sequence
  Peptide Derived from Human Papillomavirus
DGQAQPATA

SEQ ID NO: 36540 - protein, 11 aa, Artificial Sequence
  Peptide Derived from Human Papillomavirus
DGQAQPATADY

SEQ ID NO: 36541 - protein, 10 aa, Artificial Sequence
  Peptide Derived from Human Papillomavirus
DLYPEPTDLY

SEQ ID NO: 36542 - protein, 11 aa, Artificial Sequence
  Peptide Derived from Human Papillomavirus
DSSDEDEGLDR

SEQ ID NO: 36543 - protein, 10 aa, Artificial Sequence
  Peptide Derived from Human Papillomavirus
EGLDRPDGQA

SEQ ID NO: 36544 - protein, 9 aa, Artificial Sequence
  Peptide Derived from Human Papillomavirus
GLDRPDGQA

SEQ ID NO: 36545 - protein, 11 aa, Artificial Sequence
  Peptide Derived from Human Papillomavirus
GTVNIVCPTCA

SEQ ID NO: 36546 - protein, 8 aa, Artificial Sequence
  Peptide Derived from Human Papillomavirus
HTCNTTVR

SEQ ID NO: 36547 - protein, 11 aa, Artificial Sequence
  Peptide Derived from Human Papillomavirus
LCVNSTASDLR

SEQ ID NO: 36548 - protein, 11 aa, Artificial Sequence
  Peptide Derived from Human Papillomavirus
LDLYPEPTDLY

SEQ ID NO: 36549 - protein, 8 aa, Artificial Sequence
  Peptide Derived from Human Papillomavirus
LDRPDGQA

SEQ ID NO: 36550 - protein, 11 aa, Artificial Sequence
  Peptide Derived from Human Papillomavirus
LDRPDGQAQPA

SEQ ID NO: 36551 - protein, 8 aa, Artificial Sequence
  Peptide Derived from Human Papillomavirus
NIVCPTCA

SEQ ID NO: 36552 - protein, 8 aa, Artificial Sequence
  Peptide Derived from Human Papillomavirus
NSTASDLR

SEQ ID NO: 36553 - protein, 8 aa, Artificial Sequence
  Peptide Derived from Human Papillomavirus
PDGQAQPA

SEQ ID NO: 36554 - protein, 10 aa, Artificial Sequence
  Peptide Derived from Human Papillomavirus
PDGQAQPATA

SEQ ID NO: 36555 - protein, 11 aa, Artificial Sequence
  Peptide Derived from Human Papillomavirus
PTLKEYVLDLY

SEQ ID NO: 36556 - protein, 9 aa, Artificial Sequence
  Peptide Derived from Human Papillomavirus
QAQPATADY

SEQ ID NO: 36557 - protein, 10 aa, Artificial Sequence
  Peptide Derived from Human Papillomavirus
QAQPATADYY

SEQ ID NO: 36558 - protein, 8 aa, Artificial Sequence
  Peptide Derived from Human Papillomavirus
RGHKPTLK

SEQ ID NO: 36559 - protein, 10 aa, Artificial Sequence
  Peptide Derived from Human Papillomavirus
RGHKPTLKEY

SEQ ID NO: 36560 - protein, 8 aa, Artificial Sequence
  Peptide Derived from Human Papillomavirus
RLCVNSTA

SEQ ID NO: 36561 - protein, 9 aa, Artificial Sequence
  Peptide Derived from Human Papillomavirus
SDEDEGLDR

SEQ ID NO: 36562 - protein, 10 aa, Artificial Sequence
  Peptide Derived from Human Papillomavirus
SSDEDEGLDR

SEQ ID NO: 36563 - protein, 11 aa, Artificial Sequence
  Peptide Derived from Human Papillomavirus
TADYYIVTCCH

SEQ ID NO: 36564 - protein, 11 aa, Artificial Sequence
  Peptide Derived from Human Papillomavirus
TCCHTCNTTVR

SEQ ID NO: 36565 - protein, 10 aa, Artificial Sequence
  Peptide Derived from Human Papillomavirus
TLKEYVLDLY

SEQ ID NO: 36566 - protein, 11 aa, Artificial Sequence
  Peptide Derived from Human Papillomavirus
TTVRLCVNSTA

SEQ ID NO: 36567 - protein, 10 aa, Artificial Sequence
  Peptide Derived from Human Papillomavirus
TVNIVCPTCA

SEQ ID NO: 36568 - protein, 10 aa, Artificial Sequence
  Peptide Derived from Human Papillomavirus
TVRLCVNSTA

SEQ ID NO: 36569 - protein, 11 aa, Artificial Sequence
  Peptide Derived from Human Papillomavirus
AAPTSTRTSSA

SEQ ID NO: 36570 - protein, 8 aa, Artificial Sequence
  Peptide Derived from Human Papillomavirus
ACTNAAPA

SEQ ID NO: 36571 - protein, 9 aa, Artificial Sequence
  Peptide Derived from Human Papillomavirus
ACVGLEIGR

SEQ ID NO: 36572 - protein, 10 aa, Artificial Sequence
  Peptide Derived from Human Papillomavirus
ADLDQFPLGR

SEQ ID NO: 36573 - protein, 11 aa, Artificial Sequence
  Peptide Derived from Human Papillomavirus
ADLDQFPLGRK

SEQ ID NO: 36574 - protein, 11 aa, Artificial Sequence
  Peptide Derived from Human Papillomavirus
ADNRECLSMDY

SEQ ID NO: 36575 - protein, 8 aa, Artificial Sequence
  Peptide Derived from Human Papillomavirus
AGLKAKPK

SEQ ID NO: 36576 - protein, 10 aa, Artificial Sequence
  Peptide Derived from Human Papillomavirus
AGLKAKPKLK

SEQ ID NO: 36577 - protein, 11 aa, Artificial Sequence
  Peptide Derived from Human Papillomavirus
AGLKAKPKLKR

SEQ ID NO: 36578 - protein, 8 aa, Artificial Sequence
  Peptide Derived from Human Papillomavirus
AGSSRLLA

SEQ ID NO: 36579 - protein, 11 aa, Artificial Sequence
  Peptide Derived from Human Papillomavirus
AGSSRLLAVGH

SEQ ID NO: 36580 - protein, 11 aa, Artificial Sequence
  Peptide Derived from Human Papillomavirus
AITCQKTVPPK

SEQ ID NO: 36581 - protein, 8 aa, Artificial Sequence
  Peptide Derived from Human Papillomavirus
ASIQSSAF

SEQ ID NO: 36582 - protein, 9 aa, Artificial Sequence
  Peptide Derived from Human Papillomavirus
ASIQSSAFF

SEQ ID NO: 36583 - protein, 8 aa, Artificial Sequence
  Peptide Derived from Human Papillomavirus
ASLQDTYR

SEQ ID NO: 36584 - protein, 9 aa, Artificial Sequence
  Peptide Derived from Human Papillomavirus
ASLQDTYRF

SEQ ID NO: 36585 - protein, 10 aa, Artificial Sequence
  Peptide Derived from Human Papillomavirus
AVGHPYFSIK

SEQ ID NO: 36586 - protein, 9 aa, Artificial Sequence
  Peptide Derived from Human Papillomavirus
AVPDDLYIK

SEQ ID NO: 36587 - protein, 10 aa, Artificial Sequence
  Peptide Derived from Human Papillomavirus
CGSTCKYPDY

SEQ ID NO: 36588 - protein, 9 aa, Artificial Sequence
  Peptide Derived from Human Papillomavirus
CMDFKTLQA

SEQ ID NO: 36589 - protein, 11 aa, Artificial Sequence
  Peptide Derived from Human Papillomavirus
CMDFKTLQANK

SEQ ID NO: 36590 - protein, 10 aa, Artificial Sequence
  Peptide Derived from Human Papillomavirus
CTQVTSDSTY

SEQ ID NO: 36591 - protein, 11 aa, Artificial Sequence
  Peptide Derived from Human Papillomavirus
CTQVTSDSTYK

SEQ ID NO: 36592 - protein, 8 aa, Artificial Sequence
  Peptide Derived from Human Papillomavirus
CVGLEIGR

SEQ ID NO: 36593 - protein, 8 aa, Artificial Sequence
  Peptide Derived from Human Papillomavirus
DDTETGNK

SEQ ID NO: 36594 - protein, 9 aa, Artificial Sequence
  Peptide Derived from Human Papillomavirus
DDTETGNKY

SEQ ID NO: 36595 - protein, 9 aa, Artificial Sequence
  Peptide Derived from Human Papillomavirus
DFKTLQANK

SEQ ID NO: 36596 - protein, 9 aa, Artificial Sequence
  Peptide Derived from Human Papillomavirus
DGDMVDTGF

SEQ ID NO: 36597 - protein, 8 aa, Artificial Sequence
  Peptide Derived from Human Papillomavirus
DICGSTCK

SEQ ID NO: 36598 - protein, 9 aa, Artificial Sequence
  Peptide Derived from Human Papillomavirus
DICGSTCKY

SEQ ID NO: 36599 - protein, 8 aa, Artificial Sequence
  Peptide Derived from Human Papillomavirus
DILEDWQF

SEQ ID NO: 36600 - protein, 9 aa, Artificial Sequence
  Peptide Derived from Human Papillomavirus
DLDQFPLGR

SEQ ID NO: 36601 - protein, 10 aa, Artificial Sequence
  Peptide Derived from Human Papillomavirus
DLDQFPLGRK

SEQ ID NO: 36602 - protein, 11 aa, Artificial Sequence
  Peptide Derived from Human Papillomavirus
DLDQFPLGRKF

SEQ ID NO: 36603 - protein, 8 aa, Artificial Sequence
  Peptide Derived from Human Papillomavirus
DLKEKFSA

SEQ ID NO: 36604 - protein, 10 aa, Artificial Sequence
  Peptide Derived from Human Papillomavirus
DLQFVFQLCK

SEQ ID NO: 36605 - protein, 11 aa, Artificial Sequence
  Peptide Derived from Human Papillomavirus
DLYIKGSGTTA

SEQ ID NO: 36606 - protein, 8 aa, Artificial Sequence
  Peptide Derived from Human Papillomavirus
DSLFFFLR

SEQ ID NO: 36607 - protein, 9 aa, Artificial Sequence
  Peptide Derived from Human Papillomavirus
DSLFFFLRR

SEQ ID NO: 36608 - protein, 9 aa, Artificial Sequence
  Peptide Derived from Human Papillomavirus
DSTYKNENF

SEQ ID NO: 36609 - protein, 10 aa, Artificial Sequence
  Peptide Derived from Human Papillomavirus
DSTYKNENFK

SEQ ID NO: 36610 - protein, 8 aa, Artificial Sequence
  Peptide Derived from Human Papillomavirus
DTETGNKY

SEQ ID NO: 36611 - protein, 9 aa, Artificial Sequence
  Peptide Derived from Human Papillomavirus
DTGFGCMDF

SEQ ID NO: 36612 - protein, 10 aa, Artificial Sequence
  Peptide Derived from Human Papillomavirus
DTGFGCMDFK

SEQ ID NO: 36613 - protein, 8 aa, Artificial Sequence
  Peptide Derived from Human Papillomavirus
DTQRLVWA

SEQ ID NO: 36614 - protein, 11 aa, Artificial Sequence
  Peptide Derived from Human Papillomavirus
DTSFYNPDTQR

SEQ ID NO: 36615 - protein, 10 aa, Artificial Sequence
  Peptide Derived from Human Papillomavirus
DTYRFVTSQA

SEQ ID NO: 36616 - protein, 8 aa, Artificial Sequence
  Peptide Derived from Human Papillomavirus
EAVPDDLY

SEQ ID NO: 36617 - protein, 10 aa, Artificial Sequence
  Peptide Derived from Human Papillomavirus
EAVPDDLYIK

SEQ ID NO: 36618 - protein, 8 aa, Artificial Sequence
  Peptide Derived from Human Papillomavirus
ECLSMDYK

SEQ ID NO: 36619 - protein, 10 aa, Artificial Sequence
  Peptide Derived from Human Papillomavirus
EDGDMVDTGF

SEQ ID NO: 36620 - protein, 9 aa, Artificial Sequence
  Peptide Derived from Human Papillomavirus
EDPLGKYTF

SEQ ID NO: 36621 - protein, 9 aa, Artificial Sequence
  Peptide Derived from Human Papillomavirus
ESQLFNKPY

SEQ ID NO: 36622 - protein, 8 aa, Artificial Sequence
  Peptide Derived from Human Papillomavirus
EVDLKEKF

SEQ ID NO: 36623 - protein, 10 aa, Artificial Sequence
  Peptide Derived from Human Papillomavirus
EVDLKEKFSA

SEQ ID NO: 36624 - protein, 8 aa, Artificial Sequence
  Peptide Derived from Human Papillomavirus
EVMTYIHA

SEQ ID NO: 36625 - protein, 9 aa, Artificial Sequence
  Peptide Derived from Human Papillomavirus
FDDTETGNK

SEQ ID NO: 36626 - protein, 10 aa, Artificial Sequence
  Peptide Derived from Human Papillomavirus
FDDTETGNKY

SEQ ID NO: 36627 - protein, 10 aa, Artificial Sequence
  Peptide Derived from Human Papillomavirus
FFFLRREQMF

SEQ ID NO: 36628 - protein, 9 aa, Artificial Sequence
  Peptide Derived from Human Papillomavirus
FFLRREQMF

SEQ ID NO: 36629 - protein, 11 aa, Artificial Sequence
  Peptide Derived from Human Papillomavirus
FFLRREQMFVR

SEQ ID NO: 36630 - protein, 11 aa, Artificial Sequence
  Peptide Derived from Human Papillomavirus
FFNRAGTLGEA

SEQ ID NO: 36631 - protein, 11 aa, Artificial Sequence
  Peptide Derived from Human Papillomavirus
FGCMDFKTLQA

SEQ ID NO: 36632 - protein, 8 aa, Artificial Sequence
  Peptide Derived from Human Papillomavirus
FGFPDTSF

SEQ ID NO: 36633 - protein, 9 aa, Artificial Sequence
  Peptide Derived from Human Papillomavirus
FGFPDTSFY

SEQ ID NO: 36634 - protein, 9 aa, Artificial Sequence
  Peptide Derived from Human Papillomavirus
FGLTPPPSA

SEQ ID NO: 36635 - protein, 8 aa, Artificial Sequence
  Peptide Derived from Human Papillomavirus
FLLQAGLK

SEQ ID NO: 36636 - protein, 9 aa, Artificial Sequence
  Peptide Derived from Human Papillomavirus
FLLQAGLKA

SEQ ID NO: 36637 - protein, 10 aa, Artificial Sequence
  Peptide Derived from Human Papillomavirus
FLLQAGLKAK

SEQ ID NO: 36638 - protein, 8 aa, Artificial Sequence
  Peptide Derived from Human Papillomavirus
FLRREQMF

SEQ ID NO: 36639 - protein, 10 aa, Artificial Sequence
  Peptide Derived from Human Papillomavirus
FLRREQMFVR

SEQ ID NO: 36640 - protein, 11 aa, Artificial Sequence
  Peptide Derived from Human Papillomavirus
FLRREQMFVRH

SEQ ID NO: 36641 - protein, 8 aa, Artificial Sequence
  Peptide Derived from Human Papillomavirus
FSADLDQF

SEQ ID NO: 36642 - protein, 9 aa, Artificial Sequence
  Peptide Derived from Human Papillomavirus
FSIKNPTNA

SEQ ID NO: 36643 - protein, 10 aa, Artificial Sequence
  Peptide Derived from Human Papillomavirus
FSIKNPTNAK

SEQ ID NO: 36644 - protein, 11 aa, Artificial Sequence
  Peptide Derived from Human Papillomavirus
FSIKNPTNAKK

SEQ ID NO: 36645 - protein, 8 aa, Artificial Sequence
  Peptide Derived from Human Papillomavirus
FVRHFFNR

SEQ ID NO: 36646 - protein, 9 aa, Artificial Sequence
  Peptide Derived from Human Papillomavirus
FVRHFFNRA

SEQ ID NO: 36647 - protein, 11 aa, Artificial Sequence
  Peptide Derived from Human Papillomavirus
FVTSQAITCQK

SEQ ID NO: 36648 - protein, 9 aa, Artificial Sequence
  Peptide Derived from Human Papillomavirus
FVTVVDTTR

SEQ ID NO: 36649 - protein, 9 aa, Artificial Sequence
  Peptide Derived from Human Papillomavirus
GCKPPTGEH

SEQ ID NO: 36650 - protein, 10 aa, Artificial Sequence
  Peptide Derived from Human Papillomavirus
GCMDFKTLQA

SEQ ID NO: 36651 - protein, 8 aa, Artificial Sequence
  Peptide Derived from Human Papillomavirus
GDMVDTGF

SEQ ID NO: 36652 - protein, 9 aa, Artificial Sequence
  Peptide Derived from Human Papillomavirus
GDSLFFFLR

SEQ ID NO: 36653 - protein, 10 aa, Artificial Sequence
  Peptide Derived from Human Papillomavirus
GDSLFFFLRR

SEQ ID NO: 36654 - protein, 8 aa, Artificial Sequence
  Peptide Derived from Human Papillomavirus
GFGCMDFK

SEQ ID NO: 36655 - protein, 8 aa, Artificial Sequence
  Peptide Derived from Human Papillomavirus
GFPDTSFY

SEQ ID NO: 36656 - protein, 9 aa, Artificial Sequence
  Peptide Derived from Human Papillomavirus
GICWGNQVF

SEQ ID NO: 36657 - protein, 10 aa, Artificial Sequence
  Peptide Derived from Human Papillomavirus
GISGHPLLNK

SEQ ID NO: 36658 - protein, 11 aa, Artificial Sequence
  Peptide Derived from Human Papillomavirus
GISGHPLLNKF

SEQ ID NO: 36659 - protein, 9 aa, Artificial Sequence
  Peptide Derived from Human Papillomavirus
GLKAKPKLK

SEQ ID NO: 36660 - protein, 10 aa, Artificial Sequence
  Peptide Derived from Human Papillomavirus
GLKAKPKLKR

SEQ ID NO: 36661 - protein, 11 aa, Artificial Sequence
  Peptide Derived from Human Papillomavirus
GLKAKPKLKRA

SEQ ID NO: 36662 - protein, 8 aa, Artificial Sequence
  Peptide Derived from Human Papillomavirus
GLQYRVFR

SEQ ID NO: 36663 - protein, 10 aa, Artificial Sequence
  Peptide Derived from Human Papillomavirus
GLQYRVFRVR

SEQ ID NO: 36664 - protein, 8 aa, Artificial Sequence
  Peptide Derived from Human Papillomavirus
GLTPPPSA

SEQ ID NO: 36665 - protein, 11 aa, Artificial Sequence
  Peptide Derived from Human Papillomavirus
GSMVTSESQLF

SEQ ID NO: 36666 - protein, 10 aa, Artificial Sequence
  Peptide Derived from Human Papillomavirus
GSSRLLAVGH

SEQ ID NO: 36667 - protein, 9 aa, Artificial Sequence
  Peptide Derived from Human Papillomavirus
GSTCKYPDY

SEQ ID NO: 36668 - protein, 11 aa, Artificial Sequence
  Peptide Derived from Human Papillomavirus
GSTCKYPDYLK

SEQ ID NO: 36669 - protein, 10 aa, Artificial Sequence
  Peptide Derived from Human Papillomavirus
GTTASIQSSA

SEQ ID NO: 36670 - protein, 11 aa, Artificial Sequence
  Peptide Derived from Human Papillomavirus
GTTASIQSSAF

SEQ ID NO: 36671 - protein, 8 aa, Artificial Sequence
  Peptide Derived from Human Papillomavirus
GVACTNAA

SEQ ID NO: 36672 - protein, 10 aa, Artificial Sequence
  Peptide Derived from Human Papillomavirus
GVACTNAAPA

SEQ ID NO: 36673 - protein, 9 aa, Artificial Sequence
  Peptide Derived from Human Papillomavirus
HVEEYDLQF

SEQ ID NO: 36674 - protein, 11 aa, Artificial Sequence
  Peptide Derived from Human Papillomavirus
HVEEYDLQFVF

SEQ ID NO: 36675 - protein, 8 aa, Artificial Sequence
  Peptide Derived from Human Papillomavirus
ICGSTCKY

SEQ ID NO: 36676 - protein, 11 aa, Artificial Sequence
  Peptide Derived from Human Papillomavirus
ICGSTCKYPDY

SEQ ID NO: 36677 - protein, 8 aa, Artificial Sequence
  Peptide Derived from Human Papillomavirus
ICWGNQVF

SEQ ID NO: 36678 - protein, 9 aa, Artificial Sequence
  Peptide Derived from Human Papillomavirus
IDICGSTCK

SEQ ID NO: 36679 - protein, 10 aa, Artificial Sequence
  Peptide Derived from Human Papillomavirus
IDICGSTCKY

SEQ ID NO: 36680 - protein, 9 aa, Artificial Sequence
  Peptide Derived from Human Papillomavirus
ISGHPLLNK

SEQ ID NO: 36681 - protein, 10 aa, Artificial Sequence
  Peptide Derived from Human Papillomavirus
ISGHPLLNKF

SEQ ID NO: 36682 - protein, 10 aa, Artificial Sequence
  Peptide Derived from Human Papillomavirus
ITCQKTVPPK

SEQ ID NO: 36683 - protein, 8 aa, Artificial Sequence
  Peptide Derived from Human Papillomavirus
KAKPKLKR

SEQ ID NO: 36684 - protein, 9 aa, Artificial Sequence
  Peptide Derived from Human Papillomavirus
KAKPKLKRA

SEQ ID NO: 36685 - protein, 10 aa, Artificial Sequence
  Peptide Derived from Human Papillomavirus
KAKPKLKRAA

SEQ ID NO: 36686 - protein, 10 aa, Artificial Sequence
  Peptide Derived from Human Papillomavirus
KFDDTETGNK

SEQ ID NO: 36687 - protein, 11 aa, Artificial Sequence
  Peptide Derived from Human Papillomavirus
KFDDTETGNKY

SEQ ID NO: 36688 - protein, 9 aa, Artificial Sequence
  Peptide Derived from Human Papillomavirus
KFGFPDTSF

SEQ ID NO: 36689 - protein, 10 aa, Artificial Sequence
  Peptide Derived from Human Papillomavirus
KFGFPDTSFY

SEQ ID NO: 36690 - protein, 9 aa, Artificial Sequence
  Peptide Derived from Human Papillomavirus
KFLLQAGLK

SEQ ID NO: 36691 - protein, 10 aa, Artificial Sequence
  Peptide Derived from Human Papillomavirus
KFLLQAGLKA

SEQ ID NO: 36692 - protein, 11 aa, Artificial Sequence
  Peptide Derived from Human Papillomavirus
KFLLQAGLKAK

SEQ ID NO: 36693 - protein, 9 aa, Artificial Sequence
  Peptide Derived from Human Papillomavirus
KFSADLDQF

SEQ ID NO: 36694 - protein, 8 aa, Artificial Sequence
  Peptide Derived from Human Papillomavirus
KGVACTNA

SEQ ID NO: 36695 - protein, 9 aa, Artificial Sequence
  Peptide Derived from Human Papillomavirus
KGVACTNAA

SEQ ID NO: 36696 - protein, 11 aa, Artificial Sequence
  Peptide Derived from Human Papillomavirus
KGVACTNAAPA

SEQ ID NO: 36697 - protein, 11 aa, Artificial Sequence
  Peptide Derived from Human Papillomavirus
KLKRAAPTSTR

SEQ ID NO: 36698 - protein, 8 aa, Artificial Sequence
  Peptide Derived from Human Papillomavirus
KTVPPKEK

SEQ ID NO: 36699 - protein, 8 aa, Artificial Sequence
  Peptide Derived from Human Papillomavirus
KVSGLQYR

SEQ ID NO: 36700 - protein, 10 aa, Artificial Sequence
  Peptide Derived from Human Papillomavirus
KVSGLQYRVF

SEQ ID NO: 36701 - protein, 11 aa, Artificial Sequence
  Peptide Derived from Human Papillomavirus
KVSGLQYRVFR

SEQ ID NO: 36702 - protein, 11 aa, Artificial Sequence
  Peptide Derived from Human Papillomavirus
KVTLTAEVMTY

SEQ ID NO: 36703 - protein, 8 aa, Artificial Sequence
  Peptide Derived from Human Papillomavirus
KVVSTDEY

SEQ ID NO: 36704 - protein, 11 aa, Artificial Sequence
  Peptide Derived from Human Papillomavirus
KVVSTDEYVSR

SEQ ID NO: 36705 - protein, 8 aa, Artificial Sequence
  Peptide Derived from Human Papillomavirus
LAVGHPYF

SEQ ID NO: 36706 - protein, 11 aa, Artificial Sequence
  Peptide Derived from Human Papillomavirus
LAVGHPYFSIK

SEQ ID NO: 36707 - protein, 8 aa, Artificial Sequence
  Peptide Derived from Human Papillomavirus
LCKVTLTA

SEQ ID NO: 36708 - protein, 11 aa, Artificial Sequence
  Peptide Derived from Human Papillomavirus
LCTQVTSDSTY

SEQ ID NO: 36709 - protein, 8 aa, Artificial Sequence
  Peptide Derived from Human Papillomavirus
LDQFPLGR

SEQ ID NO: 36710 - protein, 9 aa, Artificial Sequence
  Peptide Derived from Human Papillomavirus
LDQFPLGRK

SEQ ID NO: 36711 - protein, 10 aa, Artificial Sequence
  Peptide Derived from Human Papillomavirus
LDQFPLGRKF

SEQ ID NO: 36712 - protein, 11 aa, Artificial Sequence
  Peptide Derived from Human Papillomavirus
LFFFLRREQMF

SEQ ID NO: 36713 - protein, 10 aa, Artificial Sequence
  Peptide Derived from Human Papillomavirus
LFNKPYWLQR

SEQ ID NO: 36714 - protein, 11 aa, Artificial Sequence
  Peptide Derived from Human Papillomavirus
LFNKPYWLQRA

SEQ ID NO: 36715 - protein, 10 aa, Artificial Sequence
  Peptide Derived from Human Papillomavirus
LGCKPPTGEH

SEQ ID NO: 36716 - protein, 10 aa, Artificial Sequence
  Peptide Derived from Human Papillomavirus
LGEAVPDDLY

SEQ ID NO: 36717 - protein, 9 aa, Artificial Sequence
  Peptide Derived from Human Papillomavirus
LGRKFLLQA

SEQ ID NO: 36718 - protein, 8 aa, Artificial Sequence
  Peptide Derived from Human Papillomavirus
LGVGISGH

SEQ ID NO: 36719 - protein, 8 aa, Artificial Sequence
  Peptide Derived from Human Papillomavirus
LLAVGHPY

SEQ ID NO: 36720 - protein, 9 aa, Artificial Sequence
  Peptide Derived from Human Papillomavirus
LLAVGHPYF

SEQ ID NO: 36721 - protein, 11 aa, Artificial Sequence
  Peptide Derived from Human Papillomavirus
LLGCKPPTGEH

SEQ ID NO: 36722 - protein, 8 aa, Artificial Sequence
  Peptide Derived from Human Papillomavirus
LLQAGLKA

SEQ ID NO: 36723 - protein, 9 aa, Artificial Sequence
  Peptide Derived from Human Papillomavirus
LLQAGLKAK

SEQ ID NO: 36724 - protein, 11 aa, Artificial Sequence
  Peptide Derived from Human Papillomavirus
LLQAGLKAKPK

SEQ ID NO: 36725 - protein, 11 aa, Artificial Sequence
  Peptide Derived from Human Papillomavirus
LLVPKVSGLQY

SEQ ID NO: 36726 - protein, 8 aa, Artificial Sequence
  Peptide Derived from Human Papillomavirus
LTAEVMTY

SEQ ID NO: 36727 - protein, 10 aa, Artificial Sequence
  Peptide Derived from Human Papillomavirus
LTAEVMTYIH

SEQ ID NO: 36728 - protein, 11 aa, Artificial Sequence
  Peptide Derived from Human Papillomavirus
LTAEVMTYIHA

SEQ ID NO: 36729 - protein, 10 aa, Artificial Sequence
  Peptide Derived from Human Papillomavirus
LVPKVSGLQY

SEQ ID NO: 36730 - protein, 11 aa, Artificial Sequence
  Peptide Derived from Human Papillomavirus
LVPKVSGLQYR

SEQ ID NO: 36731 - protein, 8 aa, Artificial Sequence
  Peptide Derived from Human Papillomavirus
MDFKTLQA

SEQ ID NO: 36732 - protein, 10 aa, Artificial Sequence
  Peptide Derived from Human Papillomavirus
MDFKTLQANK

SEQ ID NO: 36733 - protein, 9 aa, Artificial Sequence
  Peptide Derived from Human Papillomavirus
MFVRHFFNR

SEQ ID NO: 36734 - protein, 10 aa, Artificial Sequence
  Peptide Derived from Human Papillomavirus
MFVRHFFNRA

SEQ ID NO: 36735 - protein, 9 aa, Artificial Sequence
  Peptide Derived from Human Papillomavirus
MSVWRPSEA

SEQ ID NO: 36736 - protein, 11 aa, Artificial Sequence
  Peptide Derived from Human Papillomavirus
MTSEPYGDSLF

SEQ ID NO: 36737 - protein, 11 aa, Artificial Sequence
  Peptide Derived from Human Papillomavirus
MVDTGFGCMDF

SEQ ID NO: 36738 - protein, 9 aa, Artificial Sequence
  Peptide Derived from Human Papillomavirus
MVTSESQLF

SEQ ID NO: 36739 - protein, 11 aa, Artificial Sequence
  Peptide Derived from Human Papillomavirus
MVTSESQLFNK

SEQ ID NO: 36740 - protein, 9 aa, Artificial Sequence
  Peptide Derived from Human Papillomavirus
NAKKLLVPK

SEQ ID NO: 36741 - protein, 8 aa, Artificial Sequence
  Peptide Derived from Human Papillomavirus
NFKEYIRH

SEQ ID NO: 36742 - protein, 10 aa, Artificial Sequence
  Peptide Derived from Human Papillomavirus
NGICWGNQVF

SEQ ID NO: 36743 - protein, 9 aa, Artificial Sequence
  Peptide Derived from Human Papillomavirus
PDILEDWQF

SEQ ID NO: 36744 - protein, 8 aa, Artificial Sequence
  Peptide Derived from Human Papillomavirus
PDPNKFGF

SEQ ID NO: 36745 - protein, 9 aa, Artificial Sequence
  Peptide Derived from Human Papillomavirus
PDTQRLVWA

SEQ ID NO: 36746 - protein, 11 aa, Artificial Sequence
  Peptide Derived from Human Papillomavirus
PDYLKMTSEPY

SEQ ID NO: 36747 - protein, 9 aa, Artificial Sequence
  Peptide Derived from Human Papillomavirus
PGQPGADNR

SEQ ID NO: 36748 - protein, 10 aa, Artificial Sequence
  Peptide Derived from Human Papillomavirus
PIDICGSTCK

SEQ ID NO: 36749 - protein, 11 aa, Artificial Sequence
  Peptide Derived from Human Papillomavirus
PIDICGSTCKY

SEQ ID NO: 36750 - protein, 10 aa, Artificial Sequence
  Peptide Derived from Human Papillomavirus
PLGRKFLLQA

SEQ ID NO: 36751 - protein, 9 aa, Artificial Sequence
  Peptide Derived from Human Papillomavirus
PLGVGISGH

SEQ ID NO: 36752 - protein, 9 aa, Artificial Sequence
  Peptide Derived from Human Papillomavirus
PSASLQDTY

SEQ ID NO: 36753 - protein, 10 aa, Artificial Sequence
  Peptide Derived from Human Papillomavirus
PSASLQDTYR

SEQ ID NO: 36754 - protein, 11 aa, Artificial Sequence
  Peptide Derived from Human Papillomavirus
PSASLQDTYRF

SEQ ID NO: 36755 - protein, 8 aa, Artificial Sequence
  Peptide Derived from Human Papillomavirus
PTGEHWGK

SEQ ID NO: 36756 - protein, 11 aa, Artificial Sequence
  Peptide Derived from Human Papillomavirus
PTGEHWGKGVA

SEQ ID NO: 36757 - protein, 11 aa, Artificial Sequence
  Peptide Derived from Human Papillomavirus
PTNAKKLLVPK

SEQ ID NO: 36758 - protein, 9 aa, Artificial Sequence
  Peptide Derived from Human Papillomavirus
PTSTRTSSA

SEQ ID NO: 36759 - protein, 10 aa, Artificial Sequence
  Peptide Derived from Human Papillomavirus
PTSTRTSSAK

SEQ ID NO: 36760 - protein, 11 aa, Artificial Sequence
  Peptide Derived from Human Papillomavirus
PTSTRTSSAKR

SEQ ID NO: 36761 - protein, 11 aa, Artificial Sequence
  Peptide Derived from Human Papillomavirus
PVSKVVSTDEY

SEQ ID NO: 36762 - protein, 9 aa, Artificial Sequence
  Peptide Derived from Human Papillomavirus
QAGLKAKPK

SEQ ID NO: 36763 - protein, 11 aa, Artificial Sequence
  Peptide Derived from Human Papillomavirus
QAGLKAKPKLK

SEQ ID NO: 36764 - protein, 11 aa, Artificial Sequence
  Peptide Derived from Human Papillomavirus
QDTYRFVTSQA

SEQ ID NO: 36765 - protein, 10 aa, Artificial Sequence
  Peptide Derived from Human Papillomavirus
QFGLTPPPSA

SEQ ID NO: 36766 - protein, 8 aa, Artificial Sequence
  Peptide Derived from Human Papillomavirus
QFPLGRKF

SEQ ID NO: 36767 - protein, 8 aa, Artificial Sequence
  Peptide Derived from Human Papillomavirus
QFVFQLCK

SEQ ID NO: 36768 - protein, 9 aa, Artificial Sequence
  Peptide Derived from Human Papillomavirus
QLCKVTLTA

SEQ ID NO: 36769 - protein, 8 aa, Artificial Sequence
  Peptide Derived from Human Papillomavirus
QLCLLGCK

SEQ ID NO: 36770 - protein, 11 aa, Artificial Sequence
  Peptide Derived from Human Papillomavirus
QLFNKPYWLQR

SEQ ID NO: 36771 - protein, 8 aa, Artificial Sequence
  Peptide Derived from Human Papillomavirus
QMFVRHFF

SEQ ID NO: 36772 - protein, 10 aa, Artificial Sequence
  Peptide Derived from Human Papillomavirus
QMFVRHFFNR

SEQ ID NO: 36773 - protein, 11 aa, Artificial Sequence
  Peptide Derived from Human Papillomavirus
QMFVRHFFNRA

SEQ ID NO: 36774 - protein, 10 aa, Artificial Sequence
  Peptide Derived from Human Papillomavirus
QTQLCLLGCK

SEQ ID NO: 36775 - protein, 11 aa, Artificial Sequence
  Peptide Derived from Human Papillomavirus
QVFVTVVDTTR

SEQ ID NO: 36776 - protein, 8 aa, Artificial Sequence
  Peptide Derived from Human Papillomavirus
QVTSDSTY

SEQ ID NO: 36777 - protein, 9 aa, Artificial Sequence
  Peptide Derived from Human Papillomavirus
QVTSDSTYK

SEQ ID NO: 36778 - protein, 8 aa, Artificial Sequence
  Peptide Derived from Human Papillomavirus
RAAPTSTR

SEQ ID NO: 36779 - protein, 8 aa, Artificial Sequence
  Peptide Derived from Human Papillomavirus
RAGTLGEA

SEQ ID NO: 36780 - protein, 9 aa, Artificial Sequence
  Peptide Derived from Human Papillomavirus
RLLAVGHPY

SEQ ID NO: 36781 - protein, 10 aa, Artificial Sequence
  Peptide Derived from Human Papillomavirus
RLLAVGHPYF

SEQ ID NO: 36782 - protein, 8 aa, Artificial Sequence
  Peptide Derived from Human Papillomavirus
RLPDPNKF

SEQ ID NO: 36783 - protein, 10 aa, Artificial Sequence
  Peptide Derived from Human Papillomavirus
RLPDPNKFGF

SEQ ID NO: 36784 - protein, 8 aa, Artificial Sequence
  Peptide Derived from Human Papillomavirus
RTSIYYYA

SEQ ID NO: 36785 - protein, 8 aa, Artificial Sequence
  Peptide Derived from Human Papillomavirus
RTSSAKRK

SEQ ID NO: 36786 - protein, 9 aa, Artificial Sequence
  Peptide Derived from Human Papillomavirus
RTSSAKRKK

SEQ ID NO: 36787 - protein, 11 aa, Artificial Sequence
  Peptide Derived from Human Papillomavirus
RTSSAKRKKVK

SEQ ID NO: 36788 - protein, 9 aa, Artificial Sequence
  Peptide Derived from Human Papillomavirus
RVRLPDPNK

SEQ ID NO: 36789 - protein, 10 aa, Artificial Sequence
  Peptide Derived from Human Papillomavirus
RVRLPDPNKF

SEQ ID NO: 36790 - protein, 11 aa, Artificial Sequence
  Peptide Derived from Human Papillomavirus
SADLDQFPLGR

SEQ ID NO: 36791 - protein, 8 aa, Artificial Sequence
  Peptide Derived from Human Papillomavirus
SAKRKKVK

SEQ ID NO: 36792 - protein, 9 aa, Artificial Sequence
  Peptide Derived from Human Papillomavirus
SAKRKKVKK

SEQ ID NO: 36793 - protein, 8 aa, Artificial Sequence
  Peptide Derived from Human Papillomavirus
SASLQDTY

SEQ ID NO: 36794 - protein, 9 aa, Artificial Sequence
  Peptide Derived from Human Papillomavirus
SASLQDTYR

SEQ ID NO: 36795 - protein, 10 aa, Artificial Sequence
  Peptide Derived from Human Papillomavirus
SASLQDTYRF

SEQ ID NO: 36796 - protein, 10 aa, Artificial Sequence
  Peptide Derived from Human Papillomavirus
SDSTYKNENF

SEQ ID NO: 36797 - protein, 11 aa, Artificial Sequence
  Peptide Derived from Human Papillomavirus
SDSTYKNENFK

SEQ ID NO: 36798 - protein, 9 aa, Artificial Sequence
  Peptide Derived from Human Papillomavirus
SFYNPDTQR

SEQ ID NO: 36799 - protein, 8 aa, Artificial Sequence
  Peptide Derived from Human Papillomavirus
SGHPLLNK

SEQ ID NO: 36800 - protein, 9 aa, Artificial Sequence
  Peptide Derived from Human Papillomavirus
SGHPLLNKF

SEQ ID NO: 36801 - protein, 8 aa, Artificial Sequence
  Peptide Derived from Human Papillomavirus
SGLQYRVF

SEQ ID NO: 36802 - protein, 9 aa, Artificial Sequence
  Peptide Derived from Human Papillomavirus
SGLQYRVFR

SEQ ID NO: 36803 - protein, 11 aa, Artificial Sequence
  Peptide Derived from Human Papillomavirus
SGLQYRVFRVR

SEQ ID NO: 36804 - protein, 11 aa, Artificial Sequence
  Peptide Derived from Human Papillomavirus
SGTTASIQSSA

SEQ ID NO: 36805 - protein, 8 aa, Artificial Sequence
  Peptide Derived from Human Papillomavirus
SIKNPTNA

SEQ ID NO: 36806 - protein, 9 aa, Artificial Sequence
  Peptide Derived from Human Papillomavirus
SIKNPTNAK

SEQ ID NO: 36807 - protein, 10 aa, Artificial Sequence
  Peptide Derived from Human Papillomavirus
SIKNPTNAKK

SEQ ID NO: 36808 - protein, 8 aa, Artificial Sequence
  Peptide Derived from Human Papillomavirus
SIQSSAFF

SEQ ID NO: 36809 - protein, 10 aa, Artificial Sequence
  Peptide Derived from Human Papillomavirus
SIYYYAGSSR

SEQ ID NO: 36810 - protein, 8 aa, Artificial Sequence
  Peptide Derived from Human Papillomavirus
SLFFFLRR

SEQ ID NO: 36811 - protein, 8 aa, Artificial Sequence
  Peptide Derived from Human Papillomavirus
SLQDTYRF

SEQ ID NO: 36812 - protein, 10 aa, Artificial Sequence
  Peptide Derived from Human Papillomavirus
SMVTSESQLF

SEQ ID NO: 36813 - protein, 9 aa, Artificial Sequence
  Peptide Derived from Human Papillomavirus
SSAKRKKVK

SEQ ID NO: 36814 - protein, 10 aa, Artificial Sequence
  Peptide Derived from Human Papillomavirus
SSAKRKKVKK

SEQ ID NO: 36815 - protein, 9 aa, Artificial Sequence
  Peptide Derived from Human Papillomavirus
SSRLLAVGH

SEQ ID NO: 36816 - protein, 11 aa, Artificial Sequence
  Peptide Derived from Human Papillomavirus
SSRLLAVGHPY

SEQ ID NO: 36817 - protein, 8 aa, Artificial Sequence
  Peptide Derived from Human Papillomavirus
STCKYPDY

SEQ ID NO: 36818 - protein, 10 aa, Artificial Sequence
  Peptide Derived from Human Papillomavirus
STCKYPDYLK

SEQ ID NO: 36819 - protein, 8 aa, Artificial Sequence
  Peptide Derived from Human Papillomavirus
STDEYVSR

SEQ ID NO: 36820 - protein, 8 aa, Artificial Sequence
  Peptide Derived from Human Papillomavirus
STRTSSAK

SEQ ID NO: 36821 - protein, 9 aa, Artificial Sequence
  Peptide Derived from Human Papillomavirus
STRTSSAKR

SEQ ID NO: 36822 - protein, 10 aa, Artificial Sequence
  Peptide Derived from Human Papillomavirus
STRTSSAKRK

SEQ ID NO: 36823 - protein, 11 aa, Artificial Sequence
  Peptide Derived from Human Papillomavirus
STRTSSAKRKK

SEQ ID NO: 36824 - protein, 8 aa, Artificial Sequence
  Peptide Derived from Human Papillomavirus
STYKNENF

SEQ ID NO: 36825 - protein, 9 aa, Artificial Sequence
  Peptide Derived from Human Papillomavirus
STYKNENFK

SEQ ID NO: 36826 - protein, 11 aa, Artificial Sequence
  Peptide Derived from Human Papillomavirus
STYKNENFKEY

SEQ ID NO: 36827 - protein, 8 aa, Artificial Sequence
  Peptide Derived from Human Papillomavirus
SVWRPSEA

SEQ ID NO: 36828 - protein, 11 aa, Artificial Sequence
  Peptide Derived from Human Papillomavirus
SVWRPSEATVY

SEQ ID NO: 36829 - protein, 9 aa, Artificial Sequence
  Peptide Derived from Human Papillomavirus
TAEVMTYIH

SEQ ID NO: 36830 - protein, 10 aa, Artificial Sequence
  Peptide Derived from Human Papillomavirus
TAEVMTYIHA

SEQ ID NO: 36831 - protein, 8 aa, Artificial Sequence
  Peptide Derived from Human Papillomavirus
TASIQSSA

SEQ ID NO: 36832 - protein, 9 aa, Artificial Sequence
  Peptide Derived from Human Papillomavirus
TASIQSSAF

SEQ ID NO: 36833 - protein, 10 aa, Artificial Sequence
  Peptide Derived from Human Papillomavirus
TASIQSSAFF

SEQ ID NO: 36834 - protein, 9 aa, Artificial Sequence
  Peptide Derived from Human Papillomavirus
TCKYPDYLK

SEQ ID NO: 36835 - protein, 9 aa, Artificial Sequence
  Peptide Derived from Human Papillomavirus
TCQKTVPPK

SEQ ID NO: 36836 - protein, 11 aa, Artificial Sequence
  Peptide Derived from Human Papillomavirus
TCQKTVPPKEK

SEQ ID NO: 36837 - protein, 11 aa, Artificial Sequence
  Peptide Derived from Human Papillomavirus
TDEYVSRTSIY

SEQ ID NO: 36838 - protein, 8 aa, Artificial Sequence
  Peptide Derived from Human Papillomavirus
TFWEVDLK

SEQ ID NO: 36839 - protein, 10 aa, Artificial Sequence
  Peptide Derived from Human Papillomavirus
TFWEVDLKEK

SEQ ID NO: 36840 - protein, 11 aa, Artificial Sequence
  Peptide Derived from Human Papillomavirus
TFWEVDLKEKF

SEQ ID NO: 36841 - protein, 10 aa, Artificial Sequence
  Peptide Derived from Human Papillomavirus
TGEHWGKGVA

SEQ ID NO: 36842 - protein, 8 aa, Artificial Sequence
  Peptide Derived from Human Papillomavirus
TGFGCMDF

SEQ ID NO: 36843 - protein, 9 aa, Artificial Sequence
  Peptide Derived from Human Papillomavirus
TGFGCMDFK

SEQ ID NO: 36844 - protein, 11 aa, Artificial Sequence
  Peptide Derived from Human Papillomavirus
TGNKYPGQPGA

SEQ ID NO: 36845 - protein, 11 aa, Artificial Sequence
  Peptide Derived from Human Papillomavirus
TLGEAVPDDLY

SEQ ID NO: 36846 - protein, 9 aa, Artificial Sequence
  Peptide Derived from Human Papillomavirus
TLTAEVMTY

SEQ ID NO: 36847 - protein, 11 aa, Artificial Sequence
  Peptide Derived from Human Papillomavirus
TLTAEVMTYIH

SEQ ID NO: 36848 - protein, 11 aa, Artificial Sequence
  Peptide Derived from Human Papillomavirus
TSDSTYKNENF

SEQ ID NO: 36849 - protein, 10 aa, Artificial Sequence
  Peptide Derived from Human Papillomavirus
TSEPYGDSLF

SEQ ID NO: 36850 - protein, 11 aa, Artificial Sequence
  Peptide Derived from Human Papillomavirus
TSEPYGDSLFF

SEQ ID NO: 36851 - protein, 9 aa, Artificial Sequence
  Peptide Derived from Human Papillomavirus
TSESQLFNK

SEQ ID NO: 36852 - protein, 11 aa, Artificial Sequence
  Peptide Derived from Human Papillomavirus
TSESQLFNKPY

SEQ ID NO: 36853 - protein, 10 aa, Artificial Sequence
  Peptide Derived from Human Papillomavirus
TSFYNPDTQR

SEQ ID NO: 36854 - protein, 11 aa, Artificial Sequence
  Peptide Derived from Human Papillomavirus
TSIYYYAGSSR

SEQ ID NO: 36855 - protein, 9 aa, Artificial Sequence
  Peptide Derived from Human Papillomavirus
TSQAITCQK

SEQ ID NO: 36856 - protein, 8 aa, Artificial Sequence
  Peptide Derived from Human Papillomavirus
TSSAKRKK

SEQ ID NO: 36857 - protein, 10 aa, Artificial Sequence
  Peptide Derived from Human Papillomavirus
TSSAKRKKVK

SEQ ID NO: 36858 - protein, 11 aa, Artificial Sequence
  Peptide Derived from Human Papillomavirus
TSSAKRKKVKK

SEQ ID NO: 36859 - protein, 8 aa, Artificial Sequence
  Peptide Derived from Human Papillomavirus
TSTRTSSA

SEQ ID NO: 36860 - protein, 9 aa, Artificial Sequence
  Peptide Derived from Human Papillomavirus
TSTRTSSAK

SEQ ID NO: 36861 - protein, 10 aa, Artificial Sequence
  Peptide Derived from Human Papillomavirus
TSTRTSSAKR

SEQ ID NO: 36862 - protein, 11 aa, Artificial Sequence
  Peptide Derived from Human Papillomavirus
TSTRTSSAKRK

SEQ ID NO: 36863 - protein, 9 aa, Artificial Sequence
  Peptide Derived from Human Papillomavirus
TTASIQSSA

SEQ ID NO: 36864 - protein, 10 aa, Artificial Sequence
  Peptide Derived from Human Papillomavirus
TTASIQSSAF

SEQ ID NO: 36865 - protein, 11 aa, Artificial Sequence
  Peptide Derived from Human Papillomavirus
TTASIQSSAFF

SEQ ID NO: 36866 - protein, 11 aa, Artificial Sequence
  Peptide Derived from Human Papillomavirus
TVYLPPVPVSK

SEQ ID NO: 36867 - protein, 9 aa, Artificial Sequence
  Peptide Derived from Human Papillomavirus
VACTNAAPA

SEQ ID NO: 36868 - protein, 9 aa, Artificial Sequence
  Peptide Derived from Human Papillomavirus
VDLKEKFSA

SEQ ID NO: 36869 - protein, 10 aa, Artificial Sequence
  Peptide Derived from Human Papillomavirus
VDTGFGCMDF

SEQ ID NO: 36870 - protein, 11 aa, Artificial Sequence
  Peptide Derived from Human Papillomavirus
VDTGFGCMDFK

SEQ ID NO: 36871 - protein, 11 aa, Artificial Sequence
  Peptide Derived from Human Papillomavirus
VFQLCKVTLTA

SEQ ID NO: 36872 - protein, 11 aa, Artificial Sequence
  Peptide Derived from Human Papillomavirus
VFRVRLPDPNK

SEQ ID NO: 36873 - protein, 10 aa, Artificial Sequence
  Peptide Derived from Human Papillomavirus
VFVTVVDTTR

SEQ ID NO: 36874 - protein, 9 aa, Artificial Sequence
  Peptide Derived from Human Papillomavirus
VGHPYFSIK

SEQ ID NO: 36875 - protein, 11 aa, Artificial Sequence
  Peptide Derived from Human Papillomavirus
VGISGHPLLNK

SEQ ID NO: 36876 - protein, 9 aa, Artificial Sequence
  Peptide Derived from Human Papillomavirus
VSGLQYRVF

SEQ ID NO: 36877 - protein, 10 aa, Artificial Sequence
  Peptide Derived from Human Papillomavirus
VSGLQYRVFR

SEQ ID NO: 36878 - protein, 10 aa, Artificial Sequence
  Peptide Derived from Human Papillomavirus
VSKVVSTDEY

SEQ ID NO: 36879 - protein, 8 aa, Artificial Sequence
  Peptide Derived from Human Papillomavirus
VSRTSIYY

SEQ ID NO: 36880 - protein, 9 aa, Artificial Sequence
  Peptide Derived from Human Papillomavirus
VSRTSIYYY

SEQ ID NO: 36881 - protein, 10 aa, Artificial Sequence
  Peptide Derived from Human Papillomavirus
VSRTSIYYYA

SEQ ID NO: 36882 - protein, 9 aa, Artificial Sequence
  Peptide Derived from Human Papillomavirus
VSTDEYVSR

SEQ ID NO: 36883 - protein, 10 aa, Artificial Sequence
  Peptide Derived from Human Papillomavirus
VTLTAEVMTY

SEQ ID NO: 36884 - protein, 8 aa, Artificial Sequence
  Peptide Derived from Human Papillomavirus
VTSDSTYK

SEQ ID NO: 36885 - protein, 8 aa, Artificial Sequence
  Peptide Derived from Human Papillomavirus
VTSESQLF

SEQ ID NO: 36886 - protein, 10 aa, Artificial Sequence
  Peptide Derived from Human Papillomavirus
VTSESQLFNK

SEQ ID NO: 36887 - protein, 10 aa, Artificial Sequence
  Peptide Derived from Human Papillomavirus
VTSQAITCQK

SEQ ID NO: 36888 - protein, 8 aa, Artificial Sequence
  Peptide Derived from Human Papillomavirus
VTVVDTTR

SEQ ID NO: 36889 - protein, 10 aa, Artificial Sequence
  Peptide Derived from Human Papillomavirus
VVSTDEYVSR

SEQ ID NO: 36890 - protein, 10 aa, Artificial Sequence
  Peptide Derived from Human Papillomavirus
WACVGLEIGR

SEQ ID NO: 36891 - protein, 10 aa, Artificial Sequence
  Peptide Derived from Human Papillomavirus
WGKGVACTNA

SEQ ID NO: 36892 - protein, 11 aa, Artificial Sequence
  Peptide Derived from Human Papillomavirus
WGKGVACTNAA

SEQ ID NO: 36893 - protein, 8 aa, Artificial Sequence
  Peptide Derived from Human Papillomavirus
WLQRAQGH

SEQ ID NO: 36894 - protein, 9 aa, Artificial Sequence
  Peptide Derived from Human Papillomavirus
YAGSSRLLA

SEQ ID NO: 36895 - protein, 11 aa, Artificial Sequence
  Peptide Derived from Human Papillomavirus
YDLQFVFQLCK

SEQ ID NO: 36896 - protein, 10 aa, Artificial Sequence
  Peptide Derived from Human Papillomavirus
YFSIKNPTNA

SEQ ID NO: 36897 - protein, 11 aa, Artificial Sequence
  Peptide Derived from Human Papillomavirus
YFSIKNPTNAK

SEQ ID NO: 36898 - protein, 8 aa, Artificial Sequence
  Peptide Derived from Human Papillomavirus
YGDSLFFF

SEQ ID NO: 36899 - protein, 10 aa, Artificial Sequence
  Peptide Derived from Human Papillomavirus
YGDSLFFFLR

SEQ ID NO: 36900 - protein, 11 aa, Artificial Sequence
  Peptide Derived from Human Papillomavirus
YGDSLFFFLRR

SEQ ID NO: 36901 - protein, 9 aa, Artificial Sequence
  Peptide Derived from Human Papillomavirus
YIKGSGTTA

SEQ ID NO: 36902 - protein, 8 aa, Artificial Sequence
  Peptide Derived from Human Papillomavirus
YIRHVEEY

SEQ ID NO: 36903 - protein, 9 aa, Artificial Sequence
  Peptide Derived from Human Papillomavirus
YLKMTSEPY

SEQ ID NO: 36904 - protein, 9 aa, Artificial Sequence
  Peptide Derived from Human Papillomavirus
YLPPVPVSK

SEQ ID NO: 36905 - protein, 9 aa, Artificial Sequence
  Peptide Derived from Human Papillomavirus
YTFWEVDLK

SEQ ID NO: 36906 - protein, 11 aa, Artificial Sequence
  Peptide Derived from Human Papillomavirus
YTFWEVDLKEK

SEQ ID NO: 36907 - protein, 8 aa, Artificial Sequence
  Peptide Derived from Human Papillomavirus
YVSRTSIY

SEQ ID NO: 36908 - protein, 9 aa, Artificial Sequence
  Peptide Derived from Human Papillomavirus
YVSRTSIYY

SEQ ID NO: 36909 - protein, 10 aa, Artificial Sequence
  Peptide Derived from Human Papillomavirus
YVSRTSIYYY

SEQ ID NO: 36910 - protein, 11 aa, Artificial Sequence
  Peptide Derived from Human Papillomavirus
YVSRTSIYYYA

SEQ ID NO: 36911 - protein, 9 aa, Artificial Sequence
  Peptide Derived from Human Papillomavirus
AAIPLQPIR

SEQ ID NO: 36912 - protein, 8 aa, Artificial Sequence
  Peptide Derived from Human Papillomavirus
ADDVDNVH

SEQ ID NO: 36913 - protein, 9 aa, Artificial Sequence
  Peptide Derived from Human Papillomavirus
ADFVLHPSY

SEQ ID NO: 36914 - protein, 10 aa, Artificial Sequence
  Peptide Derived from Human Papillomavirus
ADFVLHPSYF

SEQ ID NO: 36915 - protein, 8 aa, Artificial Sequence
  Peptide Derived from Human Papillomavirus
AFLTSPHK

SEQ ID NO: 36916 - protein, 8 aa, Artificial Sequence
  Peptide Derived from Human Papillomavirus
AIPLQPIR

SEQ ID NO: 36917 - protein, 10 aa, Artificial Sequence
  Peptide Derived from Human Papillomavirus
AITSRRHTVR

SEQ ID NO: 36918 - protein, 11 aa, Artificial Sequence
  Peptide Derived from Human Papillomavirus
AITSRRHTVRF

SEQ ID NO: 36919 - protein, 10 aa, Artificial Sequence
  Peptide Derived from Human Papillomavirus
ALHRPAITSR

SEQ ID NO: 36920 - protein, 11 aa, Artificial Sequence
  Peptide Derived from Human Papillomavirus
ALHRPAITSRR

SEQ ID NO: 36921 - protein, 11 aa, Artificial Sequence
  Peptide Derived from Human Papillomavirus
ASATQLYQTCK

SEQ ID NO: 36922 - protein, 9 aa, Artificial Sequence
  Peptide Derived from Human Papillomavirus
ATLKTRSGK

SEQ ID NO: 36923 - protein, 9 aa, Artificial Sequence
  Peptide Derived from Human Papillomavirus
ATQLYQTCK

SEQ ID NO: 36924 - protein, 10 aa, Artificial Sequence
  Peptide Derived from Human Papillomavirus
ATQLYQTCKA

SEQ ID NO: 36925 - protein, 9 aa, Artificial Sequence
  Peptide Derived from Human Papillomavirus
DFLDIIALH

SEQ ID NO: 36926 - protein, 10 aa, Artificial Sequence
  Peptide Derived from Human Papillomavirus
DFLDIIALHR

SEQ ID NO: 36927 - protein, 8 aa, Artificial Sequence
  Peptide Derived from Human Papillomavirus
DFVLHPSY

SEQ ID NO: 36928 - protein, 9 aa, Artificial Sequence
  Peptide Derived from Human Papillomavirus
DFVLHPSYF

SEQ ID NO: 36929 - protein, 8 aa, Artificial Sequence
  Peptide Derived from Human Papillomavirus
DGADFVLH

SEQ ID NO: 36930 - protein, 11 aa, Artificial Sequence
  Peptide Derived from Human Papillomavirus
DGADFVLHPSY

SEQ ID NO: 36931 - protein, 8 aa, Artificial Sequence
  Peptide Derived from Human Papillomavirus
DGLYDVYA

SEQ ID NO: 36932 - protein, 9 aa, Artificial Sequence
  Peptide Derived from Human Papillomavirus
DIIALHRPA

SEQ ID NO: 36933 - protein, 10 aa, Artificial Sequence
  Peptide Derived from Human Papillomavirus
DISPAPDPDF

SEQ ID NO: 36934 - protein, 10 aa, Artificial Sequence
  Peptide Derived from Human Papillomavirus
DLSPIVPLDH

SEQ ID NO: 36935 - protein, 8 aa, Artificial Sequence
  Peptide Derived from Human Papillomavirus
DTIVVDGA

SEQ ID NO: 36936 - protein, 10 aa, Artificial Sequence
  Peptide Derived from Human Papillomavirus
DTIVVDGADF

SEQ ID NO: 36937 - protein, 11 aa, Artificial Sequence
  Peptide Derived from Human Papillomavirus
DVDNVHTPMQH

SEQ ID NO: 36938 - protein, 11 aa, Artificial Sequence
  Peptide Derived from Human Papillomavirus
DVTTSADTTPA

SEQ ID NO: 36939 - protein, 11 aa, Artificial Sequence
  Peptide Derived from Human Papillomavirus
DVYADDVDNVH

SEQ ID NO: 36940 - protein, 8 aa, Artificial Sequence
  Peptide Derived from Human Papillomavirus
EASGHFIF

SEQ ID NO: 36941 - protein, 8 aa, Artificial Sequence
  Peptide Derived from Human Papillomavirus
EDTLQFQH

SEQ ID NO: 36942 - protein, 11 aa, Artificial Sequence
  Peptide Derived from Human Papillomavirus
EGSTIADQILK

SEQ ID NO: 36943 - protein, 11 aa, Artificial Sequence
  Peptide Derived from Human Papillomavirus
ESFDPEDTLQF

SEQ ID NO: 36944 - protein, 10 aa, Artificial Sequence
  Peptide Derived from Human Papillomavirus
ESSIQTISTH

SEQ ID NO: 36945 - protein, 9 aa, Artificial Sequence
  Peptide Derived from Human Papillomavirus
ETSFIEAGA

SEQ ID NO: 36946 - protein, 11 aa, Artificial Sequence
  Peptide Derived from Human Papillomavirus
ETSFIEAGAPA

SEQ ID NO: 36947 - protein, 9 aa, Artificial Sequence
  Peptide Derived from Human Papillomavirus
FDPEDTLQF

SEQ ID NO: 36948 - protein, 11 aa, Artificial Sequence
  Peptide Derived from Human Papillomavirus
FDPEDTLQFQH

SEQ ID NO: 36949 - protein, 9 aa, Artificial Sequence
  Peptide Derived from Human Papillomavirus
FDTIVVDGA

SEQ ID NO: 36950 - protein, 11 aa, Artificial Sequence
  Peptide Derived from Human Papillomavirus
FDTIVVDGADF

SEQ ID NO: 36951 - protein, 8 aa, Artificial Sequence
  Peptide Derived from Human Papillomavirus
FFTDVRVA

SEQ ID NO: 36952 - protein, 9 aa, Artificial Sequence
  Peptide Derived from Human Papillomavirus
FFTDVRVAA

SEQ ID NO: 36953 - protein, 8 aa, Artificial Sequence
  Peptide Derived from Human Papillomavirus
FIEAGAPA

SEQ ID NO: 36954 - protein, 8 aa, Artificial Sequence
  Peptide Derived from Human Papillomavirus
FILRRRRK

SEQ ID NO: 36955 - protein, 9 aa, Artificial Sequence
  Peptide Derived from Human Papillomavirus
FILRRRRKR

SEQ ID NO: 36956 - protein, 10 aa, Artificial Sequence
  Peptide Derived from Human Papillomavirus
FILRRRRKRF

SEQ ID NO: 36957 - protein, 8 aa, Artificial Sequence
  Peptide Derived from Human Papillomavirus
FLDIIALH

SEQ ID NO: 36958 - protein, 9 aa, Artificial Sequence
  Peptide Derived from Human Papillomavirus
FLDIIALHR

SEQ ID NO: 36959 - protein, 11 aa, Artificial Sequence
  Peptide Derived from Human Papillomavirus
FLDIIALHRPA

SEQ ID NO: 36960 - protein, 11 aa, Artificial Sequence
  Peptide Derived from Human Papillomavirus
FLTSPHKLITY

SEQ ID NO: 36961 - protein, 8 aa, Artificial Sequence
  Peptide Derived from Human Papillomavirus
FSRVGQKA

SEQ ID NO: 36962 - protein, 11 aa, Artificial Sequence
  Peptide Derived from Human Papillomavirus
FSRVGQKATLK

SEQ ID NO: 36963 - protein, 11 aa, Artificial Sequence
  Peptide Derived from Human Papillomavirus
FSSPTVSTQSY

SEQ ID NO: 36964 - protein, 8 aa, Artificial Sequence
  Peptide Derived from Human Papillomavirus
FTDVRVAA

SEQ ID NO: 36965 - protein, 8 aa, Artificial Sequence
  Peptide Derived from Human Papillomavirus
FTEPSVLH

SEQ ID NO: 36966 - protein, 11 aa, Artificial Sequence
  Peptide Derived from Human Papillomavirus
FTEPSVLHPPA

SEQ ID NO: 36967 - protein, 8 aa, Artificial Sequence
  Peptide Derived from Human Papillomavirus
FVLHPSYF

SEQ ID NO: 36968 - protein, 11 aa, Artificial Sequence
  Peptide Derived from Human Papillomavirus
FVLHPSYFILR

SEQ ID NO: 36969 - protein, 8 aa, Artificial Sequence
  Peptide Derived from Human Papillomavirus
FVPISPFF

SEQ ID NO: 36970 - protein, 10 aa, Artificial Sequence
  Peptide Derived from Human Papillomavirus
FVPISPFFPF

SEQ ID NO: 36971 - protein, 10 aa, Artificial Sequence
  Peptide Derived from Human Papillomavirus
GADFVLHPSY

SEQ ID NO: 36972 - protein, 11 aa, Artificial Sequence
  Peptide Derived from Human Papillomavirus
GADFVLHPSYF

SEQ ID NO: 36973 - protein, 8 aa, Artificial Sequence
  Peptide Derived from Human Papillomavirus
GFDVTTSA

SEQ ID NO: 36974 - protein, 11 aa, Artificial Sequence
  Peptide Derived from Human Papillomavirus
GIGTGSGSGGR

SEQ ID NO: 36975 - protein, 11 aa, Artificial Sequence
  Peptide Derived from Human Papillomavirus
GLYSRNTQQVK

SEQ ID NO: 36976 - protein, 8 aa, Artificial Sequence
  Peptide Derived from Human Papillomavirus
GSGGRTGY

SEQ ID NO: 36977 - protein, 10 aa, Artificial Sequence
  Peptide Derived from Human Papillomavirus
GSGSGGRTGY

SEQ ID NO: 36978 - protein, 11 aa, Artificial Sequence
  Peptide Derived from Human Papillomavirus
GSRPVARLGLY

SEQ ID NO: 36979 - protein, 10 aa, Artificial Sequence
  Peptide Derived from Human Papillomavirus
GSTIADQILK

SEQ ID NO: 36980 - protein, 11 aa, Artificial Sequence
  Peptide Derived from Human Papillomavirus
GSTIADQILKY

SEQ ID NO: 36981 - protein, 10 aa, Artificial Sequence
  Peptide Derived from Human Papillomavirus
GTCPPDVIPK

SEQ ID NO: 36982 - protein, 8 aa, Artificial Sequence
  Peptide Derived from Human Papillomavirus
GTDPPTAA

SEQ ID NO: 36983 - protein, 9 aa, Artificial Sequence
  Peptide Derived from Human Papillomavirus
GTGSGSGGR

SEQ ID NO: 36984 - protein, 8 aa, Artificial Sequence
  Peptide Derived from Human Papillomavirus
HDTSTSSY

SEQ ID NO: 36985 - protein, 10 aa, Artificial Sequence
  Peptide Derived from Human Papillomavirus
HSYSTFATTR

SEQ ID NO: 36986 - protein, 8 aa, Artificial Sequence
  Peptide Derived from Human Papillomavirus
HTPMQHSY

SEQ ID NO: 36987 - protein, 11 aa, Artificial Sequence
  Peptide Derived from Human Papillomavirus
HTPMQHSYSTF

SEQ ID NO: 36988 - protein, 8 aa, Artificial Sequence
  Peptide Derived from Human Papillomavirus
HTVPNEQY

SEQ ID NO: 36989 - protein, 11 aa, Artificial Sequence
  Peptide Derived from Human Papillomavirus
HTVRFSRVGQK

SEQ ID NO: 36990 - protein, 8 aa, Artificial Sequence
  Peptide Derived from Human Papillomavirus
IADQILKY

SEQ ID NO: 36991 - protein, 11 aa, Artificial Sequence
  Peptide Derived from Human Papillomavirus
IALHRPAITSR

SEQ ID NO: 36992 - protein, 8 aa, Artificial Sequence
  Peptide Derived from Human Papillomavirus
IGARIHYY

SEQ ID NO: 36993 - protein, 8 aa, Artificial Sequence
  Peptide Derived from Human Papillomavirus
IGTDPPTA

SEQ ID NO: 36994 - protein, 9 aa, Artificial Sequence
  Peptide Derived from Human Papillomavirus
IGTDPPTAA

SEQ ID NO: 36995 - protein, 10 aa, Artificial Sequence
  Peptide Derived from Human Papillomavirus
IGTGSGSGGR

SEQ ID NO: 36996 - protein, 8 aa, Artificial Sequence
  Peptide Derived from Human Papillomavirus
IIALHRPA

SEQ ID NO: 36997 - protein, 10 aa, Artificial Sequence
  Peptide Derived from Human Papillomavirus
ILKYGSLGVF

SEQ ID NO: 36998 - protein, 11 aa, Artificial Sequence
  Peptide Derived from Human Papillomavirus
ILKYGSLGVFF

SEQ ID NO: 36999 - protein, 8 aa, Artificial Sequence
  Peptide Derived from Human Papillomavirus
ILRRRRKR

SEQ ID NO: 37000 - protein, 9 aa, Artificial Sequence
  Peptide Derived from Human Papillomavirus
ILRRRRKRF

SEQ ID NO: 37001 - protein, 11 aa, Artificial Sequence
  Peptide Derived from Human Papillomavirus
ILRRRRKRFPY

SEQ ID NO: 37002 - protein, 9 aa, Artificial Sequence
  Peptide Derived from Human Papillomavirus
ISPAPDPDF

SEQ ID NO: 37003 - protein, 9 aa, Artificial Sequence
  Peptide Derived from Human Papillomavirus
ISTHLNPTF

SEQ ID NO: 37004 - protein, 9 aa, Artificial Sequence
  Peptide Derived from Human Papillomavirus
ITSRRHTVR

SEQ ID NO: 37005 - protein, 10 aa, Artificial Sequence
  Peptide Derived from Human Papillomavirus
ITSRRHTVRF

SEQ ID NO: 37006 - protein, 8 aa, Artificial Sequence
  Peptide Derived from Human Papillomavirus
ITYDNPAF

SEQ ID NO: 37007 - protein, 11 aa, Artificial Sequence
  Peptide Derived from Human Papillomavirus
ITYDNPAFESF

SEQ ID NO: 37008 - protein, 10 aa, Artificial Sequence
  Peptide Derived from Human Papillomavirus
IVSLIEETSF

SEQ ID NO: 37009 - protein, 8 aa, Artificial Sequence
  Peptide Derived from Human Papillomavirus
IVVDGADF

SEQ ID NO: 37010 - protein, 11 aa, Artificial Sequence
  Peptide Derived from Human Papillomavirus
IVVDGADFVLH

SEQ ID NO: 37011 - protein, 10 aa, Artificial Sequence
  Peptide Derived from Human Papillomavirus
KATLKTRSGK

SEQ ID NO: 37012 - protein, 9 aa, Artificial Sequence
  Peptide Derived from Human Papillomavirus
KLITYDNPA

SEQ ID NO: 37013 - protein, 10 aa, Artificial Sequence
  Peptide Derived from Human Papillomavirus
KLITYDNPAF

SEQ ID NO: 37014 - protein, 10 aa, Artificial Sequence
  Peptide Derived from Human Papillomavirus
KTRSGKQIGA

SEQ ID NO: 37015 - protein, 11 aa, Artificial Sequence
  Peptide Derived from Human Papillomavirus
KTRSGKQIGAR

SEQ ID NO: 37016 - protein, 8 aa, Artificial Sequence
  Peptide Derived from Human Papillomavirus
KVEGSTIA

SEQ ID NO: 37017 - protein, 10 aa, Artificial Sequence
  Peptide Derived from Human Papillomavirus
LDHTVPNEQY

SEQ ID NO: 37018 - protein, 8 aa, Artificial Sequence
  Peptide Derived from Human Papillomavirus
LDIIALHR

SEQ ID NO: 37019 - protein, 10 aa, Artificial Sequence
  Peptide Derived from Human Papillomavirus
LDIIALHRPA

SEQ ID NO: 37020 - protein, 8 aa, Artificial Sequence
  Peptide Derived from Human Papillomavirus
LFPTSSPF

SEQ ID NO: 37021 - protein, 10 aa, Artificial Sequence
  Peptide Derived from Human Papillomavirus
LIEETSFIEA

SEQ ID NO: 37022 - protein, 8 aa, Artificial Sequence
  Peptide Derived from Human Papillomavirus
LITYDNPA

SEQ ID NO: 37023 - protein, 9 aa, Artificial Sequence
  Peptide Derived from Human Papillomavirus
LITYDNPAF

SEQ ID NO: 37024 - protein, 9 aa, Artificial Sequence
  Peptide Derived from Human Papillomavirus
LSPIVPLDH

SEQ ID NO: 37025 - protein, 10 aa, Artificial Sequence
  Peptide Derived from Human Papillomavirus
LTSPHKLITY

SEQ ID NO: 37026 - protein, 11 aa, Artificial Sequence
  Peptide Derived from Human Papillomavirus
MSGPDIPSPLF

SEQ ID NO: 37027 - protein, 8 aa, Artificial Sequence
  Peptide Derived from Human Papillomavirus
NDGLYDVY

SEQ ID NO: 37028 - protein, 9 aa, Artificial Sequence
  Peptide Derived from Human Papillomavirus
NDGLYDVYA

SEQ ID NO: 37029 - protein, 11 aa, Artificial Sequence
  Peptide Derived from Human Papillomavirus
NTQQVKVVDPA

SEQ ID NO: 37030 - protein, 8 aa, Artificial Sequence
  Peptide Derived from Human Papillomavirus
NVHTPMQH

SEQ ID NO: 37031 - protein, 10 aa, Artificial Sequence
  Peptide Derived from Human Papillomavirus
NVHTPMQHSY

SEQ ID NO: 37032 - protein, 10 aa, Artificial Sequence
  Peptide Derived from Human Papillomavirus
NVSIPLNTGF

SEQ ID NO: 37033 - protein, 8 aa, Artificial Sequence
  Peptide Derived from Human Papillomavirus
PAEASGHF

SEQ ID NO: 37034 - protein, 10 aa, Artificial Sequence
  Peptide Derived from Human Papillomavirus
PAEASGHFIF

SEQ ID NO: 37035 - protein, 8 aa, Artificial Sequence
  Peptide Derived from Human Papillomavirus
PAFLTSPH

SEQ ID NO: 37036 - protein, 9 aa, Artificial Sequence
  Peptide Derived from Human Papillomavirus
PAFLTSPHK

SEQ ID NO: 37037 - protein, 8 aa, Artificial Sequence
  Peptide Derived from Human Papillomavirus
PAITSRRH

SEQ ID NO: 37038 - protein, 11 aa, Artificial Sequence
  Peptide Derived from Human Papillomavirus
PAITSRRHTVR

SEQ ID NO: 37039 - protein, 9 aa, Artificial Sequence
  Peptide Derived from Human Papillomavirus
PAPAEASGH

SEQ ID NO: 37040 - protein, 10 aa, Artificial Sequence
  Peptide Derived from Human Papillomavirus
PAPAEASGHF

SEQ ID NO: 37041 - protein, 11 aa, Artificial Sequence
  Peptide Derived from Human Papillomavirus
PAPSIPTPSGF

SEQ ID NO: 37042 - protein, 8 aa, Artificial Sequence
  Peptide Derived from Human Papillomavirus
PDFLDIIA

SEQ ID NO: 37043 - protein, 10 aa, Artificial Sequence
  Peptide Derived from Human Papillomavirus
PDFLDIIALH

SEQ ID NO: 37044 - protein, 11 aa, Artificial Sequence
  Peptide Derived from Human Papillomavirus
PDFLDIIALHR

SEQ ID NO: 37045 - protein, 8 aa, Artificial Sequence
  Peptide Derived from Human Papillomavirus
PDIPSPLF

SEQ ID NO: 37046 - protein, 10 aa, Artificial Sequence
  Peptide Derived from Human Papillomavirus
PDPDFLDIIA

SEQ ID NO: 37047 - protein, 10 aa, Artificial Sequence
  Peptide Derived from Human Papillomavirus
PFDTIVVDGA

SEQ ID NO: 37048 - protein, 8 aa, Artificial Sequence
  Peptide Derived from Human Papillomavirus
PFVPISPF

SEQ ID NO: 37049 - protein, 9 aa, Artificial Sequence
  Peptide Derived from Human Papillomavirus
PFVPISPFF

SEQ ID NO: 37050 - protein, 11 aa, Artificial Sequence
  Peptide Derived from Human Papillomavirus
PFVPISPFFPF

SEQ ID NO: 37051 - protein, 8 aa, Artificial Sequence
  Peptide Derived from Human Papillomavirus
PGSRPVAR

SEQ ID NO: 37052 - protein, 9 aa, Artificial Sequence
  Peptide Derived from Human Papillomavirus
PIGTDPPTA

SEQ ID NO: 37053 - protein, 10 aa, Artificial Sequence
  Peptide Derived from Human Papillomavirus
PIGTDPPTAA

SEQ ID NO: 37054 - protein, 9 aa, Artificial Sequence
  Peptide Derived from Human Papillomavirus
PIPGSRPVA

SEQ ID NO: 37055 - protein, 10 aa, Artificial Sequence
  Peptide Derived from Human Papillomavirus
PIPGSRPVAR

SEQ ID NO: 37056 - protein, 8 aa, Artificial Sequence
  Peptide Derived from Human Papillomavirus
PISPFFPF

SEQ ID NO: 37057 - protein, 11 aa, Artificial Sequence
  Peptide Derived from Human Papillomavirus
PLDHTVPNEQY

SEQ ID NO: 37058 - protein, 9 aa, Artificial Sequence
  Peptide Derived from Human Papillomavirus
PLFPTSSPF

SEQ ID NO: 37059 - protein, 10 aa, Artificial Sequence
  Peptide Derived from Human Papillomavirus
PLHDTSTSSY

SEQ ID NO: 37060 - protein, 9 aa, Artificial Sequence
  Peptide Derived from Human Papillomavirus
PMQHSYSTF

SEQ ID NO: 37061 - protein, 10 aa, Artificial Sequence
  Peptide Derived from Human Papillomavirus
PMQHSYSTFA

SEQ ID NO: 37062 - protein, 10 aa, Artificial Sequence
  Peptide Derived from Human Papillomavirus
PSGFDVTTSA

SEQ ID NO: 37063 - protein, 9 aa, Artificial Sequence
  Peptide Derived from Human Papillomavirus
PSIPTPSGF

SEQ ID NO: 37064 - protein, 11 aa, Artificial Sequence
  Peptide Derived from Human Papillomavirus
PSPLFPTSSPF

SEQ ID NO: 37065 - protein, 8 aa, Artificial Sequence
  Peptide Derived from Human Papillomavirus
PSVLHPPA

SEQ ID NO: 37066 - protein, 10 aa, Artificial Sequence
  Peptide Derived from Human Papillomavirus
PSVLHPPAPA

SEQ ID NO: 37067 - protein, 8 aa, Artificial Sequence
  Peptide Derived from Human Papillomavirus
PSYFILRR

SEQ ID NO: 37068 - protein, 9 aa, Artificial Sequence
  Peptide Derived from Human Papillomavirus
PSYFILRRR

SEQ ID NO: 37069 - protein, 10 aa, Artificial Sequence
  Peptide Derived from Human Papillomavirus
PSYFILRRRR

SEQ ID NO: 37070 - protein, 11 aa, Artificial Sequence
  Peptide Derived from Human Papillomavirus
PSYFILRRRRK

SEQ ID NO: 37071 - protein, 11 aa, Artificial Sequence
  Peptide Derived from Human Papillomavirus
PTAAIPLQPIR

SEQ ID NO: 37072 - protein, 10 aa, Artificial Sequence
  Peptide Derived from Human Papillomavirus
PTFTEPSVLH

SEQ ID NO: 37073 - protein, 8 aa, Artificial Sequence
  Peptide Derived from Human Papillomavirus
PTVSTQSY

SEQ ID NO: 37074 - protein, 8 aa, Artificial Sequence
  Peptide Derived from Human Papillomavirus
PVARLGLY

SEQ ID NO: 37075 - protein, 10 aa, Artificial Sequence
  Peptide Derived from Human Papillomavirus
PVARLGLYSR

SEQ ID NO: 37076 - protein, 11 aa, Artificial Sequence
  Peptide Derived from Human Papillomavirus
QDLSPIVPLDH

SEQ ID NO: 37077 - protein, 10 aa, Artificial Sequence
  Peptide Derived from Human Papillomavirus
QFQHSDISPA

SEQ ID NO: 37078 - protein, 8 aa, Artificial Sequence
  Peptide Derived from Human Papillomavirus
QIGARIHY

SEQ ID NO: 37079 - protein, 9 aa, Artificial Sequence
  Peptide Derived from Human Papillomavirus
QIGARIHYY

SEQ ID NO: 37080 - protein, 11 aa, Artificial Sequence
  Peptide Derived from Human Papillomavirus
QILKYGSLGVF

SEQ ID NO: 37081 - protein, 8 aa, Artificial Sequence
  Peptide Derived from Human Papillomavirus
QLYQTCKA

SEQ ID NO: 37082 - protein, 11 aa, Artificial Sequence
  Peptide Derived from Human Papillomavirus
QSYENIPMDTF

SEQ ID NO: 37083 - protein, 11 aa, Artificial Sequence
  Peptide Derived from Human Papillomavirus
QTISTHLNPTF

SEQ ID NO: 37084 - protein, 8 aa, Artificial Sequence
  Peptide Derived from Human Papillomavirus
QVKVVDPA

SEQ ID NO: 37085 - protein, 9 aa, Artificial Sequence
  Peptide Derived from Human Papillomavirus
QVKVVDPAF

SEQ ID NO: 37086 - protein, 8 aa, Artificial Sequence
  Peptide Derived from Human Papillomavirus
RASATQLY

SEQ ID NO: 37087 - protein, 10 aa, Artificial Sequence
  Peptide Derived from Human Papillomavirus
RFPYFFTDVR

SEQ ID NO: 37088 - protein, 8 aa, Artificial Sequence
  Peptide Derived from Human Papillomavirus
RFSRVGQK

SEQ ID NO: 37089 - protein, 9 aa, Artificial Sequence
  Peptide Derived from Human Papillomavirus
RFSRVGQKA

SEQ ID NO: 37090 - protein, 8 aa, Artificial Sequence
  Peptide Derived from Human Papillomavirus
RSGKQIGA

SEQ ID NO: 37091 - protein, 9 aa, Artificial Sequence
  Peptide Derived from Human Papillomavirus
RSGKQIGAR

SEQ ID NO: 37092 - protein, 11 aa, Artificial Sequence
  Peptide Derived from Human Papillomavirus
RSGKQIGARIH

SEQ ID NO: 37093 - protein, 8 aa, Artificial Sequence
  Peptide Derived from Human Papillomavirus
RSTRRKRA

SEQ ID NO: 37094 - protein, 10 aa, Artificial Sequence
  Peptide Derived from Human Papillomavirus
RSTRRKRASA

SEQ ID NO: 37095 - protein, 9 aa, Artificial Sequence
  Peptide Derived from Human Papillomavirus
RVGQKATLK

SEQ ID NO: 37096 - protein, 11 aa, Artificial Sequence
  Peptide Derived from Human Papillomavirus
RVGQKATLKTR

SEQ ID NO: 37097 - protein, 10 aa, Artificial Sequence
  Peptide Derived from Human Papillomavirus
SATQLYQTCK

SEQ ID NO: 37098 - protein, 11 aa, Artificial Sequence
  Peptide Derived from Human Papillomavirus
SATQLYQTCKA

SEQ ID NO: 37099 - protein, 11 aa, Artificial Sequence
  Peptide Derived from Human Papillomavirus
SDISPAPDPDF

SEQ ID NO: 37100 - protein, 10 aa, Artificial Sequence
  Peptide Derived from Human Papillomavirus
SFDPEDTLQF

SEQ ID NO: 37101 - protein, 9 aa, Artificial Sequence
  Peptide Derived from Human Papillomavirus
SFIEAGAPA

SEQ ID NO: 37102 - protein, 9 aa, Artificial Sequence
  Peptide Derived from Human Papillomavirus
SGFDVTTSA

SEQ ID NO: 37103 - protein, 8 aa, Artificial Sequence
  Peptide Derived from Human Papillomavirus
SGKQIGAR

SEQ ID NO: 37104 - protein, 10 aa, Artificial Sequence
  Peptide Derived from Human Papillomavirus
SGKQIGARIH

SEQ ID NO: 37105 - protein, 11 aa, Artificial Sequence
  Peptide Derived from Human Papillomavirus
SGKQIGARIHY

SEQ ID NO: 37106 - protein, 10 aa, Artificial Sequence
  Peptide Derived from Human Papillomavirus
SGPDIPSPLF

SEQ ID NO: 37107 - protein, 9 aa, Artificial Sequence
  Peptide Derived from Human Papillomavirus
SGSGGRTGY

SEQ ID NO: 37108 - protein, 10 aa, Artificial Sequence
  Peptide Derived from Human Papillomavirus
SINDGLYDVY

SEQ ID NO: 37109 - protein, 11 aa, Artificial Sequence
  Peptide Derived from Human Papillomavirus
SINDGLYDVYA

SEQ ID NO: 37110 - protein, 8 aa, Artificial Sequence
  Peptide Derived from Human Papillomavirus
SIPLNTGF

SEQ ID NO: 37111 - protein, 8 aa, Artificial Sequence
  Peptide Derived from Human Papillomavirus
SIPTPSGF

SEQ ID NO: 37112 - protein, 8 aa, Artificial Sequence
  Peptide Derived from Human Papillomavirus
SIQTISTH

SEQ ID NO: 37113 - protein, 11 aa, Artificial Sequence
  Peptide Derived from Human Papillomavirus
SIVSLIEETSF

SEQ ID NO: 37114 - protein, 8 aa, Artificial Sequence
  Peptide Derived from Human Papillomavirus
SLIEETSF

SEQ ID NO: 37115 - protein, 11 aa, Artificial Sequence
  Peptide Derived from Human Papillomavirus
SLIEETSFIEA

SEQ ID NO: 37116 - protein, 9 aa, Artificial Sequence
  Peptide Derived from Human Papillomavirus
SSIQTISTH

SEQ ID NO: 37117 - protein, 10 aa, Artificial Sequence
  Peptide Derived from Human Papillomavirus
SSPFVPISPF

SEQ ID NO: 37118 - protein, 11 aa, Artificial Sequence
  Peptide Derived from Human Papillomavirus
SSPFVPISPFF

SEQ ID NO: 37119 - protein, 10 aa, Artificial Sequence
  Peptide Derived from Human Papillomavirus
SSPTVSTQSY

SEQ ID NO: 37120 - protein, 9 aa, Artificial Sequence
  Peptide Derived from Human Papillomavirus
SSTPIPGSR

SEQ ID NO: 37121 - protein, 10 aa, Artificial Sequence
  Peptide Derived from Human Papillomavirus
SSYSINDGLY

SEQ ID NO: 37122 - protein, 8 aa, Artificial Sequence
  Peptide Derived from Human Papillomavirus
STHLNPTF

SEQ ID NO: 37123 - protein, 9 aa, Artificial Sequence
  Peptide Derived from Human Papillomavirus
STIADQILK

SEQ ID NO: 37124 - protein, 10 aa, Artificial Sequence
  Peptide Derived from Human Papillomavirus
STIADQILKY

SEQ ID NO: 37125 - protein, 8 aa, Artificial Sequence
  Peptide Derived from Human Papillomavirus
STPIPGSR

SEQ ID NO: 37126 - protein, 11 aa, Artificial Sequence
  Peptide Derived from Human Papillomavirus
STPIPGSRPVA

SEQ ID NO: 37127 - protein, 9 aa, Artificial Sequence
  Peptide Derived from Human Papillomavirus
STRRKRASA

SEQ ID NO: 37128 - protein, 9 aa, Artificial Sequence
  Peptide Derived from Human Papillomavirus
SVLHPPAPA

SEQ ID NO: 37129 - protein, 11 aa, Artificial Sequence
  Peptide Derived from Human Papillomavirus
SVLHPPAPAEA

SEQ ID NO: 37130 - protein, 10 aa, Artificial Sequence
  Peptide Derived from Human Papillomavirus
TAAIPLQPIR

SEQ ID NO: 37131 - protein, 9 aa, Artificial Sequence
  Peptide Derived from Human Papillomavirus
TCPPDVIPK

SEQ ID NO: 37132 - protein, 9 aa, Artificial Sequence
  Peptide Derived from Human Papillomavirus
TFTEPSVLH

SEQ ID NO: 37133 - protein, 8 aa, Artificial Sequence
  Peptide Derived from Human Papillomavirus
TGSGSGGR

SEQ ID NO: 37134 - protein, 11 aa, Artificial Sequence
  Peptide Derived from Human Papillomavirus
TGSGSGGRTGY

SEQ ID NO: 37135 - protein, 11 aa, Artificial Sequence
  Peptide Derived from Human Papillomavirus
TGTCPPDVIPK

SEQ ID NO: 37136 - protein, 8 aa, Artificial Sequence
  Peptide Derived from Human Papillomavirus
TIADQILK

SEQ ID NO: 37137 - protein, 9 aa, Artificial Sequence
  Peptide Derived from Human Papillomavirus
TIADQILKY

SEQ ID NO: 37138 - protein, 10 aa, Artificial Sequence
  Peptide Derived from Human Papillomavirus
TISTHLNPTF

SEQ ID NO: 37139 - protein, 9 aa, Artificial Sequence
  Peptide Derived from Human Papillomavirus
TIVVDGADF

SEQ ID NO: 37140 - protein, 8 aa, Artificial Sequence
  Peptide Derived from Human Papillomavirus
TLKTRSGK

SEQ ID NO: 37141 - protein, 8 aa, Artificial Sequence
  Peptide Derived from Human Papillomavirus
TSADTTPA

SEQ ID NO: 37142 - protein, 8 aa, Artificial Sequence
  Peptide Derived from Human Papillomavirus
TSFIEAGA

SEQ ID NO: 37143 - protein, 10 aa, Artificial Sequence
  Peptide Derived from Human Papillomavirus
TSFIEAGAPA

SEQ ID NO: 37144 - protein, 9 aa, Artificial Sequence
  Peptide Derived from Human Papillomavirus
TSPHKLITY

SEQ ID NO: 37145 - protein, 8 aa, Artificial Sequence
  Peptide Derived from Human Papillomavirus
TSRRHTVR

SEQ ID NO: 37146 - protein, 9 aa, Artificial Sequence
  Peptide Derived from Human Papillomavirus
TSRRHTVRF

SEQ ID NO: 37147 - protein, 11 aa, Artificial Sequence
  Peptide Derived from Human Papillomavirus
TSRRHTVRFSR

SEQ ID NO: 37148 - protein, 11 aa, Artificial Sequence
  Peptide Derived from Human Papillomavirus
TSSPFVPISPF

SEQ ID NO: 37149 - protein, 10 aa, Artificial Sequence
  Peptide Derived from Human Papillomavirus
TSSTPIPGSR

SEQ ID NO: 37150 - protein, 11 aa, Artificial Sequence
  Peptide Derived from Human Papillomavirus
TSSYSINDGLY

SEQ ID NO: 37151 - protein, 9 aa, Artificial Sequence
  Peptide Derived from Human Papillomavirus
TTSADTTPA

SEQ ID NO: 37152 - protein, 10 aa, Artificial Sequence
  Peptide Derived from Human Papillomavirus
TVRFSRVGQK

SEQ ID NO: 37153 - protein, 11 aa, Artificial Sequence
  Peptide Derived from Human Papillomavirus
TVRFSRVGQKA

SEQ ID NO: 37154 - protein, 9 aa, Artificial Sequence
  Peptide Derived from Human Papillomavirus
VARLGLYSR

SEQ ID NO: 37155 - protein, 9 aa, Artificial Sequence
  Peptide Derived from Human Papillomavirus
VDGADFVLH

SEQ ID NO: 37156 - protein, 10 aa, Artificial Sequence
  Peptide Derived from Human Papillomavirus
VDNVHTPMQH

SEQ ID NO: 37157 - protein, 10 aa, Artificial Sequence
  Peptide Derived from Human Papillomavirus
VDPAFLTSPH

SEQ ID NO: 37158 - protein, 11 aa, Artificial Sequence
  Peptide Derived from Human Papillomavirus
VDPAFLTSPHK

SEQ ID NO: 37159 - protein, 8 aa, Artificial Sequence
  Peptide Derived from Human Papillomavirus
VGQKATLK

SEQ ID NO: 37160 - protein, 10 aa, Artificial Sequence
  Peptide Derived from Human Papillomavirus
VGQKATLKTR

SEQ ID NO: 37161 - protein, 11 aa, Artificial Sequence
  Peptide Derived from Human Papillomavirus
VIPKVEGSTIA

SEQ ID NO: 37162 - protein, 8 aa, Artificial Sequence
  Peptide Derived from Human Papillomavirus
VLHPPAPA

SEQ ID NO: 37163 - protein, 10 aa, Artificial Sequence
  Peptide Derived from Human Papillomavirus
VLHPPAPAEA

SEQ ID NO: 37164 - protein, 10 aa, Artificial Sequence
  Peptide Derived from Human Papillomavirus
VLHPSYFILR

SEQ ID NO: 37165 - protein, 11 aa, Artificial Sequence
  Peptide Derived from Human Papillomavirus
VLHPSYFILRR

SEQ ID NO: 37166 - protein, 9 aa, Artificial Sequence
  Peptide Derived from Human Papillomavirus
VSIPLNTGF

SEQ ID NO: 37167 - protein, 9 aa, Artificial Sequence
  Peptide Derived from Human Papillomavirus
VSLIEETSF

SEQ ID NO: 37168 - protein, 11 aa, Artificial Sequence
  Peptide Derived from Human Papillomavirus
VTSSTPIPGSR

SEQ ID NO: 37169 - protein, 10 aa, Artificial Sequence
  Peptide Derived from Human Papillomavirus
VTTSADTTPA

SEQ ID NO: 37170 - protein, 10 aa, Artificial Sequence
  Peptide Derived from Human Papillomavirus
VVDGADFVLH

SEQ ID NO: 37171 - protein, 11 aa, Artificial Sequence
  Peptide Derived from Human Papillomavirus
VVDPAFLTSPH

SEQ ID NO: 37172 - protein, 9 aa, Artificial Sequence
  Peptide Derived from Human Papillomavirus
YADDVDNVH

SEQ ID NO: 37173 - protein, 9 aa, Artificial Sequence
  Peptide Derived from Human Papillomavirus
YDNPAFESF

SEQ ID NO: 37174 - protein, 9 aa, Artificial Sequence
  Peptide Derived from Human Papillomavirus
YFFTDVRVA

SEQ ID NO: 37175 - protein, 10 aa, Artificial Sequence
  Peptide Derived from Human Papillomavirus
YFFTDVRVAA

SEQ ID NO: 37176 - protein, 8 aa, Artificial Sequence
  Peptide Derived from Human Papillomavirus
YFILRRRR

SEQ ID NO: 37177 - protein, 9 aa, Artificial Sequence
  Peptide Derived from Human Papillomavirus
YFILRRRRK

SEQ ID NO: 37178 - protein, 10 aa, Artificial Sequence
  Peptide Derived from Human Papillomavirus
YFILRRRRKR

SEQ ID NO: 37179 - protein, 11 aa, Artificial Sequence
  Peptide Derived from Human Papillomavirus
YFILRRRRKRF

SEQ ID NO: 37180 - protein, 8 aa, Artificial Sequence
  Peptide Derived from Human Papillomavirus
YGSLGVFF

SEQ ID NO: 37181 - protein, 8 aa, Artificial Sequence
  Peptide Derived from Human Papillomavirus
YSINDGLY

SEQ ID NO: 37182 - protein, 11 aa, Artificial Sequence
  Peptide Derived from Human Papillomavirus
YSINDGLYDVY

SEQ ID NO: 37183 - protein, 9 aa, Artificial Sequence
  Peptide Derived from Human Papillomavirus
YSRNTQQVK

SEQ ID NO: 37184 - protein, 8 aa, Artificial Sequence
  Peptide Derived from Human Papillomavirus
YSTFATTR

SEQ ID NO: 37185 - protein, 11 aa, Artificial Sequence
  Peptide Derived from Human Papillomavirus
YVPIGTDPPTA

SEQ ID NO: 37186 - protein, 11 aa, Artificial Sequence
  Peptide Derived from Human Papillomavirus
AAAFLKSNCQA

SEQ ID NO: 37187 - protein, 10 aa, Artificial Sequence
  Peptide Derived from Human Papillomavirus
AAFLKSNCQA

SEQ ID NO: 37188 - protein, 11 aa, Artificial Sequence
  Peptide Derived from Human Papillomavirus
AAFLKSNCQAK

SEQ ID NO: 37189 - protein, 8 aa, Artificial Sequence
  Peptide Derived from Human Papillomavirus
AAMLAVFK

SEQ ID NO: 37190 - protein, 11 aa, Artificial Sequence
  Peptide Derived from Human Papillomavirus
AAMLAVFKDIY

SEQ ID NO: 37191 - protein, 8 aa, Artificial Sequence
  Peptide Derived from Human Papillomavirus
ADCNSNAA

SEQ ID NO: 37192 - protein, 9 aa, Artificial Sequence
  Peptide Derived from Human Papillomavirus
ADCNSNAAA

SEQ ID NO: 37193 - protein, 10 aa, Artificial Sequence
  Peptide Derived from Human Papillomavirus
ADCNSNAAAF

SEQ ID NO: 37194 - protein, 8 aa, Artificial Sequence
  Peptide Derived from Human Papillomavirus
ADTEGIPF

SEQ ID NO: 37195 - protein, 11 aa, Artificial Sequence
  Peptide Derived from Human Papillomavirus
ADTEGIPFGTF

SEQ ID NO: 37196 - protein, 11 aa, Artificial Sequence
  Peptide Derived from Human Papillomavirus
ADTKVAMLDDA

SEQ ID NO: 37197 - protein, 9 aa, Artificial Sequence
  Peptide Derived from Human Papillomavirus
AFLKSNCQA

SEQ ID NO: 37198 - protein, 10 aa, Artificial Sequence
  Peptide Derived from Human Papillomavirus
AFLKSNCQAK

SEQ ID NO: 37199 - protein, 11 aa, Artificial Sequence
  Peptide Derived from Human Papillomavirus
AFLKSNCQAKY

SEQ ID NO: 37200 - protein, 8 aa, Artificial Sequence
  Peptide Derived from Human Papillomavirus
AFQYAQLA

SEQ ID NO: 37201 - protein, 10 aa, Artificial Sequence
  Peptide Derived from Human Papillomavirus
AIFGVNPTVA

SEQ ID NO: 37202 - protein, 11 aa, Artificial Sequence
  Peptide Derived from Human Papillomavirus
AIISFVNSNSH

SEQ ID NO: 37203 - protein, 11 aa, Artificial Sequence
  Peptide Derived from Human Papillomavirus
ALDGNPISIDR

SEQ ID NO: 37204 - protein, 11 aa, Artificial Sequence
  Peptide Derived from Human Papillomavirus
ALKEFLKGTPK

SEQ ID NO: 37205 - protein, 9 aa, Artificial Sequence
  Peptide Derived from Human Papillomavirus
ALLRYKCGK

SEQ ID NO: 37206 - protein, 11 aa, Artificial Sequence
  Peptide Derived from Human Papillomavirus
ALLRYKCGKNR

SEQ ID NO: 37207 - protein, 10 aa, Artificial Sequence
  Peptide Derived from Human Papillomavirus
AMLAVFKDIY

SEQ ID NO: 37208 - protein, 8 aa, Artificial Sequence
  Peptide Derived from Human Papillomavirus
AMLDDATH

SEQ ID NO: 37209 - protein, 10 aa, Artificial Sequence
  Peptide Derived from Human Papillomavirus
ASNKKAAMLA

SEQ ID NO: 37210 - protein, 11 aa, Artificial Sequence
  Peptide Derived from Human Papillomavirus
ATDTGSDMVDF

SEQ ID NO: 37211 - protein, 8 aa, Artificial Sequence
  Peptide Derived from Human Papillomavirus
ATHTCWTY

SEQ ID NO: 37212 - protein, 9 aa, Artificial Sequence
  Peptide Derived from Human Papillomavirus
ATHTCWTYF

SEQ ID NO: 37213 - protein, 11 aa, Artificial Sequence
  Peptide Derived from Human Papillomavirus
AVFKDIYGLSF

SEQ ID NO: 37214 - protein, 8 aa, Artificial Sequence
  Peptide Derived from Human Papillomavirus
AVMCRHYK

SEQ ID NO: 37215 - protein, 9 aa, Artificial Sequence
  Peptide Derived from Human Papillomavirus
AVMCRHYKR

SEQ ID NO: 37216 - protein, 10 aa, Artificial Sequence
  Peptide Derived from Human Papillomavirus
AVMCRHYKRA

SEQ ID NO: 37217 - protein, 8 aa, Artificial Sequence
  Peptide Derived from Human Papillomavirus
CAVMCRHY

SEQ ID NO: 37218 - protein, 9 aa, Artificial Sequence
  Peptide Derived from Human Papillomavirus
CAVMCRHYK

SEQ ID NO: 37219 - protein, 10 aa, Artificial Sequence
  Peptide Derived from Human Papillomavirus
CAVMCRHYKR

SEQ ID NO: 37220 - protein, 11 aa, Artificial Sequence
  Peptide Derived from Human Papillomavirus
CAVMCRHYKRA

SEQ ID NO: 37221 - protein, 9 aa, Artificial Sequence
  Peptide Derived from Human Papillomavirus
CFFERTWSR

SEQ ID NO: 37222 - protein, 9 aa, Artificial Sequence
  Peptide Derived from Human Papillomavirus
CGKNRLTVA

SEQ ID NO: 37223 - protein, 10 aa, Artificial Sequence
  Peptide Derived from Human Papillomavirus
CGKNRLTVAK

SEQ ID NO: 37224 - protein, 8 aa, Artificial Sequence
  Peptide Derived from Human Papillomavirus
CILLYGPA

SEQ ID NO: 37225 - protein, 8 aa, Artificial Sequence
  Peptide Derived from Human Papillomavirus
CMLIEPPK

SEQ ID NO: 37226 - protein, 10 aa, Artificial Sequence
  Peptide Derived from Human Papillomavirus
CMLIEPPKLR

SEQ ID NO: 37227 - protein, 11 aa, Artificial Sequence
  Peptide Derived from Human Papillomavirus
CSKIDEGGDWR

SEQ ID NO: 37228 - protein, 9 aa, Artificial Sequence
  Peptide Derived from Human Papillomavirus
CTDWVMAIF

SEQ ID NO: 37229 - protein, 8 aa, Artificial Sequence
  Peptide Derived from Human Papillomavirus
CVTGQNTR

SEQ ID NO: 37230 - protein, 9 aa, Artificial Sequence
  Peptide Derived from Human Papillomavirus
DADTEGIPF

SEQ ID NO: 37231 - protein, 9 aa, Artificial Sequence
  Peptide Derived from Human Papillomavirus
DAQVLHLLK

SEQ ID NO: 37232 - protein, 10 aa, Artificial Sequence
  Peptide Derived from Human Papillomavirus
DAQVLHLLKR

SEQ ID NO: 37233 - protein, 11 aa, Artificial Sequence
  Peptide Derived from Human Papillomavirus
DAQVLHLLKRK

SEQ ID NO: 37234 - protein, 9 aa, Artificial Sequence
  Peptide Derived from Human Papillomavirus
DATHTCWTY

SEQ ID NO: 37235 - protein, 10 aa, Artificial Sequence
  Peptide Derived from Human Papillomavirus
DATHTCWTYF

SEQ ID NO: 37236 - protein, 8 aa, Artificial Sequence
  Peptide Derived from Human Papillomavirus
DCAVMCRH

SEQ ID NO: 37237 - protein, 9 aa, Artificial Sequence
  Peptide Derived from Human Papillomavirus
DCAVMCRHY

SEQ ID NO: 37238 - protein, 10 aa, Artificial Sequence
  Peptide Derived from Human Papillomavirus
DCAVMCRHYK

SEQ ID NO: 37239 - protein, 11 aa, Artificial Sequence
  Peptide Derived from Human Papillomavirus
DCAVMCRHYKR

SEQ ID NO: 37240 - protein, 10 aa, Artificial Sequence
  Peptide Derived from Human Papillomavirus
DCKWGVLILA

SEQ ID NO: 37241 - protein, 8 aa, Artificial Sequence
  Peptide Derived from Human Papillomavirus
DCNSNAAA

SEQ ID NO: 37242 - protein, 9 aa, Artificial Sequence
  Peptide Derived from Human Papillomavirus
DCNSNAAAF

SEQ ID NO: 37243 - protein, 11 aa, Artificial Sequence
  Peptide Derived from Human Papillomavirus
DCNSNAAAFLK

SEQ ID NO: 37244 - protein, 10 aa, Artificial Sequence
  Peptide Derived from Human Papillomavirus
DDATHTCWTY

SEQ ID NO: 37245 - protein, 11 aa, Artificial Sequence
  Peptide Derived from Human Papillomavirus
DDATHTCWTYF

SEQ ID NO: 37246 - protein, 11 aa, Artificial Sequence
  Peptide Derived from Human Papillomavirus
DGEGTGCNGWF

SEQ ID NO: 37247 - protein, 9 aa, Artificial Sequence
  Peptide Derived from Human Papillomavirus
DGNPISIDR

SEQ ID NO: 37248 - protein, 10 aa, Artificial Sequence
  Peptide Derived from Human Papillomavirus
DGNPISIDRK

SEQ ID NO: 37249 - protein, 11 aa, Artificial Sequence
  Peptide Derived from Human Papillomavirus
DGNPISIDRKH

SEQ ID NO: 37250 - protein, 9 aa, Artificial Sequence
  Peptide Derived from Human Papillomavirus
DLHEDDEDA

SEQ ID NO: 37251 - protein, 9 aa, Artificial Sequence
  Peptide Derived from Human Papillomavirus
DLSDMVQWA

SEQ ID NO: 37252 - protein, 10 aa, Artificial Sequence
  Peptide Derived from Human Papillomavirus
DLSDMVQWAF

SEQ ID NO: 37253 - protein, 9 aa, Artificial Sequence
  Peptide Derived from Human Papillomavirus
DLTDESDMA

SEQ ID NO: 37254 - protein, 10 aa, Artificial Sequence
  Peptide Derived from Human Papillomavirus
DLTDESDMAF

SEQ ID NO: 37255 - protein, 10 aa, Artificial Sequence
  Peptide Derived from Human Papillomavirus
DLVRNFKSDK

SEQ ID NO: 37256 - protein, 10 aa, Artificial Sequence
  Peptide Derived from Human Papillomavirus
DMAFQYAQLA

SEQ ID NO: 37257 - protein, 11 aa, Artificial Sequence
  Peptide Derived from Human Papillomavirus
DSGYGCSEVEA

SEQ ID NO: 37258 - protein, 10 aa, Artificial Sequence
  Peptide Derived from Human Papillomavirus
DTEGIPFGTF

SEQ ID NO: 37259 - protein, 11 aa, Artificial Sequence
  Peptide Derived from Human Papillomavirus
DTEGIPFGTFK

SEQ ID NO: 37260 - protein, 9 aa, Artificial Sequence
  Peptide Derived from Human Papillomavirus
DTGSDMVDF

SEQ ID NO: 37261 - protein, 10 aa, Artificial Sequence
  Peptide Derived from Human Papillomavirus
DTKVAMLDDA

SEQ ID NO: 37262 - protein, 8 aa, Artificial Sequence
  Peptide Derived from Human Papillomavirus
DTPEWIQR

SEQ ID NO: 37263 - protein, 10 aa, Artificial Sequence
  Peptide Derived from Human Papillomavirus
DTQLSICEQA

SEQ ID NO: 37264 - protein, 11 aa, Artificial Sequence
  Peptide Derived from Human Papillomavirus
DVISDDEDETA

SEQ ID NO: 37265 - protein, 10 aa, Artificial Sequence
  Peptide Derived from Human Papillomavirus
EDADTEGIPF

SEQ ID NO: 37266 - protein, 8 aa, Artificial Sequence
  Peptide Derived from Human Papillomavirus
EFISFLRA

SEQ ID NO: 37267 - protein, 10 aa, Artificial Sequence
  Peptide Derived from Human Papillomavirus
EFISFLRALK

SEQ ID NO: 37268 - protein, 8 aa, Artificial Sequence
  Peptide Derived from Human Papillomavirus
EFLKGTPK

SEQ ID NO: 37269 - protein, 9 aa, Artificial Sequence
  Peptide Derived from Human Papillomavirus
EFLKGTPKK

SEQ ID NO: 37270 - protein, 8 aa, Artificial Sequence
  Peptide Derived from Human Papillomavirus
EGFKTLIK

SEQ ID NO: 37271 - protein, 10 aa, Artificial Sequence
  Peptide Derived from Human Papillomavirus
EGFKTLIKPA

SEQ ID NO: 37272 - protein, 11 aa, Artificial Sequence
  Peptide Derived from Human Papillomavirus
EGGDWRPIVQF

SEQ ID NO: 37273 - protein, 8 aa, Artificial Sequence
  Peptide Derived from Human Papillomavirus
EGIPFGTF

SEQ ID NO: 37274 - protein, 9 aa, Artificial Sequence
  Peptide Derived from Human Papillomavirus
EGIPFGTFK

SEQ ID NO: 37275 - protein, 9 aa, Artificial Sequence
  Peptide Derived from Human Papillomavirus
EGTGCNGWF

SEQ ID NO: 37276 - protein, 10 aa, Artificial Sequence
  Peptide Derived from Human Papillomavirus
EGTGCNGWFF

SEQ ID NO: 37277 - protein, 8 aa, Artificial Sequence
  Peptide Derived from Human Papillomavirus
EINDKNWK

SEQ ID NO: 37278 - protein, 10 aa, Artificial Sequence
  Peptide Derived from Human Papillomavirus
EINDKNWKCF

SEQ ID NO: 37279 - protein, 11 aa, Artificial Sequence
  Peptide Derived from Human Papillomavirus
EINDKNWKCFF

SEQ ID NO: 37280 - protein, 8 aa, Artificial Sequence
  Peptide Derived from Human Papillomavirus
EISLNSGH

SEQ ID NO: 37281 - protein, 9 aa, Artificial Sequence
  Peptide Derived from Human Papillomavirus
EISLNSGHK

SEQ ID NO: 37282 - protein, 10 aa, Artificial Sequence
  Peptide Derived from Human Papillomavirus
EISLNSGHKK

SEQ ID NO: 37283 - protein, 11 aa, Artificial Sequence
  Peptide Derived from Human Papillomavirus
EISLNSGHKKA

SEQ ID NO: 37284 - protein, 8 aa, Artificial Sequence
  Peptide Derived from Human Papillomavirus
ELKELLQA

SEQ ID NO: 37285 - protein, 11 aa, Artificial Sequence
  Peptide Derived from Human Papillomavirus
ELKELLQASNK

SEQ ID NO: 37286 - protein, 8 aa, Artificial Sequence
  Peptide Derived from Human Papillomavirus
ELLQASNK

SEQ ID NO: 37287 - protein, 9 aa, Artificial Sequence
  Peptide Derived from Human Papillomavirus
ELLQASNKK

SEQ ID NO: 37288 - protein, 10 aa, Artificial Sequence
  Peptide Derived from Human Papillomavirus
ELLQASNKKA

SEQ ID NO: 37289 - protein, 11 aa, Artificial Sequence
  Peptide Derived from Human Papillomavirus
ELLQASNKKAA

SEQ ID NO: 37290 - protein, 8 aa, Artificial Sequence
  Peptide Derived from Human Papillomavirus
ESDMAFQY

SEQ ID NO: 37291 - protein, 9 aa, Artificial Sequence
  Peptide Derived from Human Papillomavirus
ESDMAFQYA

SEQ ID NO: 37292 - protein, 9 aa, Artificial Sequence
  Peptide Derived from Human Papillomavirus
ESRVTVFTF

SEQ ID NO: 37293 - protein, 11 aa, Artificial Sequence
  Peptide Derived from Human Papillomavirus
ESRVTVFTFPH

SEQ ID NO: 37294 - protein, 8 aa, Artificial Sequence
  Peptide Derived from Human Papillomavirus
ETAQALFH

SEQ ID NO: 37295 - protein, 9 aa, Artificial Sequence
  Peptide Derived from Human Papillomavirus
ETAQALFHA

SEQ ID NO: 37296 - protein, 10 aa, Artificial Sequence
  Peptide Derived from Human Papillomavirus
ETCMLIEPPK

SEQ ID NO: 37297 - protein, 10 aa, Artificial Sequence
  Peptide Derived from Human Papillomavirus
ETQVTVNTNA

SEQ ID NO: 37298 - protein, 10 aa, Artificial Sequence
  Peptide Derived from Human Papillomavirus
EVQNDAQVLH

SEQ ID NO: 37299 - protein, 9 aa, Artificial Sequence
  Peptide Derived from Human Papillomavirus
FDKNGNPVY

SEQ ID NO: 37300 - protein, 10 aa, Artificial Sequence
  Peptide Derived from Human Papillomavirus
FDLSDMVQWA

SEQ ID NO: 37301 - protein, 11 aa, Artificial Sequence
  Peptide Derived from Human Papillomavirus
FDLSDMVQWAF

SEQ ID NO: 37302 - protein, 8 aa, Artificial Sequence
  Peptide Derived from Human Papillomavirus
FDNYMRNA

SEQ ID NO: 37303 - protein, 8 aa, Artificial Sequence
  Peptide Derived from Human Papillomavirus
FFERTWSR

SEQ ID NO: 37304 - protein, 9 aa, Artificial Sequence
  Peptide Derived from Human Papillomavirus
FFVETIVEK

SEQ ID NO: 37305 - protein, 10 aa, Artificial Sequence
  Peptide Derived from Human Papillomavirus
FFVETIVEKK

SEQ ID NO: 37306 - protein, 8 aa, Artificial Sequence
  Peptide Derived from Human Papillomavirus
FGMSFIHF

SEQ ID NO: 37307 - protein, 8 aa, Artificial Sequence
  Peptide Derived from Human Papillomavirus
FGVNPTVA

SEQ ID NO: 37308 - protein, 11 aa, Artificial Sequence
  Peptide Derived from Human Papillomavirus
FGVNPTVAEGF

SEQ ID NO: 37309 - protein, 8 aa, Artificial Sequence
  Peptide Derived from Human Papillomavirus
FIHFLQGA

SEQ ID NO: 37310 - protein, 9 aa, Artificial Sequence
  Peptide Derived from Human Papillomavirus
FISFLRALK

SEQ ID NO: 37311 - protein, 11 aa, Artificial Sequence
  Peptide Derived from Human Papillomavirus
FISFLRALKEF

SEQ ID NO: 37312 - protein, 8 aa, Artificial Sequence
  Peptide Derived from Human Papillomavirus
FLKGTPKK

SEQ ID NO: 37313 - protein, 8 aa, Artificial Sequence
  Peptide Derived from Human Papillomavirus
FLKSNCQA

SEQ ID NO: 37314 - protein, 9 aa, Artificial Sequence
  Peptide Derived from Human Papillomavirus
FLKSNCQAK

SEQ ID NO: 37315 - protein, 10 aa, Artificial Sequence
  Peptide Derived from Human Papillomavirus
FLKSNCQAKY

SEQ ID NO: 37316 - protein, 9 aa, Artificial Sequence
  Peptide Derived from Human Papillomavirus
FLQGAIISF

SEQ ID NO: 37317 - protein, 8 aa, Artificial Sequence
  Peptide Derived from Human Papillomavirus
FLRALKEF

SEQ ID NO: 37318 - protein, 10 aa, Artificial Sequence
  Peptide Derived from Human Papillomavirus
FLRALKEFLK

SEQ ID NO: 37319 - protein, 9 aa, Artificial Sequence
  Peptide Derived from Human Papillomavirus
FLRYQGVEF

SEQ ID NO: 37320 - protein, 8 aa, Artificial Sequence
  Peptide Derived from Human Papillomavirus
FTDLVRNF

SEQ ID NO: 37321 - protein, 9 aa, Artificial Sequence
  Peptide Derived from Human Papillomavirus
FTDLVRNFK

SEQ ID NO: 37322 - protein, 9 aa, Artificial Sequence
  Peptide Derived from Human Papillomavirus
FTFPHAFPF

SEQ ID NO: 37323 - protein, 11 aa, Artificial Sequence
  Peptide Derived from Human Papillomavirus
FTFPHAFPFDK

SEQ ID NO: 37324 - protein, 8 aa, Artificial Sequence
  Peptide Derived from Human Papillomavirus
FTISDSGY

SEQ ID NO: 37325 - protein, 8 aa, Artificial Sequence
  Peptide Derived from Human Papillomavirus
FVETIVEK

SEQ ID NO: 37326 - protein, 9 aa, Artificial Sequence
  Peptide Derived from Human Papillomavirus
FVETIVEKK

SEQ ID NO: 37327 - protein, 8 aa, Artificial Sequence
  Peptide Derived from Human Papillomavirus
FVNSNSHF

SEQ ID NO: 37328 - protein, 8 aa, Artificial Sequence
  Peptide Derived from Human Papillomavirus
GCSEVEAA

SEQ ID NO: 37329 - protein, 9 aa, Artificial Sequence
  Peptide Derived from Human Papillomavirus
GDTPEWIQR

SEQ ID NO: 37330 - protein, 9 aa, Artificial Sequence
  Peptide Derived from Human Papillomavirus
GDWRPIVQF

SEQ ID NO: 37331 - protein, 11 aa, Artificial Sequence
  Peptide Derived from Human Papillomavirus
GDWRPIVQFLR

SEQ ID NO: 37332 - protein, 9 aa, Artificial Sequence
  Peptide Derived from Human Papillomavirus
GFKTLIKPA

SEQ ID NO: 37333 - protein, 8 aa, Artificial Sequence
  Peptide Derived from Human Papillomavirus
GGDSSDNA

SEQ ID NO: 37334 - protein, 10 aa, Artificial Sequence
  Peptide Derived from Human Papillomavirus
GGDWRPIVQF

SEQ ID NO: 37335 - protein, 8 aa, Artificial Sequence
  Peptide Derived from Human Papillomavirus
GIPFGTFK

SEQ ID NO: 37336 - protein, 9 aa, Artificial Sequence
  Peptide Derived from Human Papillomavirus
GLSFTDLVR

SEQ ID NO: 37337 - protein, 11 aa, Artificial Sequence
  Peptide Derived from Human Papillomavirus
GLSFTDLVRNF

SEQ ID NO: 37338 - protein, 11 aa, Artificial Sequence
  Peptide Derived from Human Papillomavirus
GMSFIHFLQGA

SEQ ID NO: 37339 - protein, 8 aa, Artificial Sequence
  Peptide Derived from Human Papillomavirus
GTGCNGWF

SEQ ID NO: 37340 - protein, 9 aa, Artificial Sequence
  Peptide Derived from Human Papillomavirus
GTGCNGWFF

SEQ ID NO: 37341 - protein, 11 aa, Artificial Sequence
  Peptide Derived from Human Papillomavirus
GTPKKNCILLY

SEQ ID NO: 37342 - protein, 9 aa, Artificial Sequence
  Peptide Derived from Human Papillomavirus
GVEFISFLR

SEQ ID NO: 37343 - protein, 10 aa, Artificial Sequence
  Peptide Derived from Human Papillomavirus
GVEFISFLRA

SEQ ID NO: 37344 - protein, 9 aa, Artificial Sequence
  Peptide Derived from Human Papillomavirus
GVLILALLR

SEQ ID NO: 37345 - protein, 10 aa, Artificial Sequence
  Peptide Derived from Human Papillomavirus
GVLILALLRY

SEQ ID NO: 37346 - protein, 11 aa, Artificial Sequence
  Peptide Derived from Human Papillomavirus
GVLILALLRYK

SEQ ID NO: 37347 - protein, 10 aa, Artificial Sequence
  Peptide Derived from Human Papillomavirus
GVNPTVAEGF

SEQ ID NO: 37348 - protein, 11 aa, Artificial Sequence
  Peptide Derived from Human Papillomavirus
GVNPTVAEGFK

SEQ ID NO: 37349 - protein, 9 aa, Artificial Sequence
  Peptide Derived from Human Papillomavirus
HAQEVQNDA

SEQ ID NO: 37350 - protein, 8 aa, Artificial Sequence
  Peptide Derived from Human Papillomavirus
HCSITELK

SEQ ID NO: 37351 - protein, 10 aa, Artificial Sequence
  Peptide Derived from Human Papillomavirus
HFLQGAIISF

SEQ ID NO: 37352 - protein, 8 aa, Artificial Sequence
  Peptide Derived from Human Papillomavirus
HFWLEPLA

SEQ ID NO: 37353 - protein, 11 aa, Artificial Sequence
  Peptide Derived from Human Papillomavirus
HFWLEPLADTK

SEQ ID NO: 37354 - protein, 8 aa, Artificial Sequence
  Peptide Derived from Human Papillomavirus
HGIDDSNF

SEQ ID NO: 37355 - protein, 8 aa, Artificial Sequence
  Peptide Derived from Human Papillomavirus
HIQCLDCK

SEQ ID NO: 37356 - protein, 8 aa, Artificial Sequence
  Peptide Derived from Human Papillomavirus
HLLKRKFA

SEQ ID NO: 37357 - protein, 10 aa, Artificial Sequence
  Peptide Derived from Human Papillomavirus
HTCWTYFDNY

SEQ ID NO: 37358 - protein, 10 aa, Artificial Sequence
  Peptide Derived from Human Papillomavirus
ICEQAEQETA

SEQ ID NO: 37359 - protein, 8 aa, Artificial Sequence
  Peptide Derived from Human Papillomavirus
IDEGGDWR

SEQ ID NO: 37360 - protein, 8 aa, Artificial Sequence
  Peptide Derived from Human Papillomavirus
IDPAKDNK

SEQ ID NO: 37361 - protein, 11 aa, Artificial Sequence
  Peptide Derived from Human Papillomavirus
IDPAKDNKWPY

SEQ ID NO: 37362 - protein, 11 aa, Artificial Sequence
  Peptide Derived from Human Papillomavirus
IDTQLSICEQA

SEQ ID NO: 37363 - protein, 9 aa, Artificial Sequence
  Peptide Derived from Human Papillomavirus
IFGVNPTVA

SEQ ID NO: 37364 - protein, 11 aa, Artificial Sequence
  Peptide Derived from Human Papillomavirus
IIQHGIDDSNF

SEQ ID NO: 37365 - protein, 10 aa, Artificial Sequence
  Peptide Derived from Human Papillomavirus
IISFVNSNSH

SEQ ID NO: 37366 - protein, 11 aa, Artificial Sequence
  Peptide Derived from Human Papillomavirus
IISFVNSNSHF

SEQ ID NO: 37367 - protein, 8 aa, Artificial Sequence
  Peptide Derived from Human Papillomavirus
ILALLRYK

SEQ ID NO: 37368 - protein, 11 aa, Artificial Sequence
  Peptide Derived from Human Papillomavirus
ILALLRYKCGK

SEQ ID NO: 37369 - protein, 10 aa, Artificial Sequence
  Peptide Derived from Human Papillomavirus
ILLTSNIDPA

SEQ ID NO: 37370 - protein, 11 aa, Artificial Sequence
  Peptide Derived from Human Papillomavirus
ILLTSNIDPAK

SEQ ID NO: 37371 - protein, 11 aa, Artificial Sequence
  Peptide Derived from Human Papillomavirus
ILLYGPANTGK

SEQ ID NO: 37372 - protein, 9 aa, Artificial Sequence
  Peptide Derived from Human Papillomavirus
ISDDEDETA

SEQ ID NO: 37373 - protein, 8 aa, Artificial Sequence
  Peptide Derived from Human Papillomavirus
ISFLRALK

SEQ ID NO: 37374 - protein, 10 aa, Artificial Sequence
  Peptide Derived from Human Papillomavirus
ISFLRALKEF

SEQ ID NO: 37375 - protein, 9 aa, Artificial Sequence
  Peptide Derived from Human Papillomavirus
ISFVNSNSH

SEQ ID NO: 37376 - protein, 10 aa, Artificial Sequence
  Peptide Derived from Human Papillomavirus
ISFVNSNSHF

SEQ ID NO: 37377 - protein, 8 aa, Artificial Sequence
  Peptide Derived from Human Papillomavirus
ISIDRKHK

SEQ ID NO: 37378 - protein, 8 aa, Artificial Sequence
  Peptide Derived from Human Papillomavirus
ISLNSGHK

SEQ ID NO: 37379 - protein, 9 aa, Artificial Sequence
  Peptide Derived from Human Papillomavirus
ISLNSGHKK

SEQ ID NO: 37380 - protein, 10 aa, Artificial Sequence
  Peptide Derived from Human Papillomavirus
ISLNSGHKKA

SEQ ID NO: 37381 - protein, 11 aa, Artificial Sequence
  Peptide Derived from Human Papillomavirus
ISLNSGHKKAK

SEQ ID NO: 37382 - protein, 10 aa, Artificial Sequence
  Peptide Derived from Human Papillomavirus
ITELKELLQA

SEQ ID NO: 37383 - protein, 8 aa, Artificial Sequence
  Peptide Derived from Human Papillomavirus
KAAMLAVF

SEQ ID NO: 37384 - protein, 9 aa, Artificial Sequence
  Peptide Derived from Human Papillomavirus
KAAMLAVFK

SEQ ID NO: 37385 - protein, 10 aa, Artificial Sequence
  Peptide Derived from Human Papillomavirus
KCFFERTWSR

SEQ ID NO: 37386 - protein, 10 aa, Artificial Sequence
  Peptide Derived from Human Papillomavirus
KCGKNRLTVA

SEQ ID NO: 37387 - protein, 11 aa, Artificial Sequence
  Peptide Derived from Human Papillomavirus
KCGKNRLTVAK

SEQ ID NO: 37388 - protein, 9 aa, Artificial Sequence
  Peptide Derived from Human Papillomavirus
KCVTGQNTR

SEQ ID NO: 37389 - protein, 8 aa, Artificial Sequence
  Peptide Derived from Human Papillomavirus
KDCAVMCR

SEQ ID NO: 37390 - protein, 9 aa, Artificial Sequence
  Peptide Derived from Human Papillomavirus
KDCAVMCRH

SEQ ID NO: 37391 - protein, 10 aa, Artificial Sequence
  Peptide Derived from Human Papillomavirus
KDCAVMCRHY

SEQ ID NO: 37392 - protein, 11 aa, Artificial Sequence
  Peptide Derived from Human Papillomavirus
KDCAVMCRHYK

SEQ ID NO: 37393 - protein, 8 aa, Artificial Sequence
  Peptide Derived from Human Papillomavirus
KDIYGLSF

SEQ ID NO: 37394 - protein, 11 aa, Artificial Sequence
  Peptide Derived from Human Papillomavirus
KDNKWPYLESR

SEQ ID NO: 37395 - protein, 8 aa, Artificial Sequence
  Peptide Derived from Human Papillomavirus
KGLSTLLH

SEQ ID NO: 37396 - protein, 9 aa, Artificial Sequence
  Peptide Derived from Human Papillomavirus
KIDEGGDWR

SEQ ID NO: 37397 - protein, 8 aa, Artificial Sequence
  Peptide Derived from Human Papillomavirus
KLRSSVAA

SEQ ID NO: 37398 - protein, 10 aa, Artificial Sequence
  Peptide Derived from Human Papillomavirus
KLRSSVAALY

SEQ ID NO: 37399 - protein, 8 aa, Artificial Sequence
  Peptide Derived from Human Papillomavirus
KSNCQAKY

SEQ ID NO: 37400 - protein, 10 aa, Artificial Sequence
  Peptide Derived from Human Papillomavirus
KSNCQAKYLK

SEQ ID NO: 37401 - protein, 8 aa, Artificial Sequence
  Peptide Derived from Human Papillomavirus
KSYFGMSF

SEQ ID NO: 37402 - protein, 10 aa, Artificial Sequence
  Peptide Derived from Human Papillomavirus
KSYFGMSFIH

SEQ ID NO: 37403 - protein, 11 aa, Artificial Sequence
  Peptide Derived from Human Papillomavirus
KSYFGMSFIHF

SEQ ID NO: 37404 - protein, 10 aa, Artificial Sequence
  Peptide Derived from Human Papillomavirus
KTLIKPATLY

SEQ ID NO: 37405 - protein, 11 aa, Artificial Sequence
  Peptide Derived from Human Papillomavirus
KTLIKPATLYA

SEQ ID NO: 37406 - protein, 10 aa, Artificial Sequence
  Peptide Derived from Human Papillomavirus
KTTCTDWVMA

SEQ ID NO: 37407 - protein, 8 aa, Artificial Sequence
  Peptide Derived from Human Papillomavirus
KVAMLDDA

SEQ ID NO: 37408 - protein, 10 aa, Artificial Sequence
  Peptide Derived from Human Papillomavirus
KVAMLDDATH

SEQ ID NO: 37409 - protein, 8 aa, Artificial Sequence
  Peptide Derived from Human Papillomavirus
LADCNSNA

SEQ ID NO: 37410 - protein, 9 aa, Artificial Sequence
  Peptide Derived from Human Papillomavirus
LADCNSNAA

SEQ ID NO: 37411 - protein, 10 aa, Artificial Sequence
  Peptide Derived from Human Papillomavirus
LADCNSNAAA

SEQ ID NO: 37412 - protein, 11 aa, Artificial Sequence
  Peptide Derived from Human Papillomavirus
LADCNSNAAAF

SEQ ID NO: 37413 - protein, 10 aa, Artificial Sequence
  Peptide Derived from Human Papillomavirus
LALLRYKCGK

SEQ ID NO: 37414 - protein, 8 aa, Artificial Sequence
  Peptide Derived from Human Papillomavirus
LAVFKDIY

SEQ ID NO: 37415 - protein, 11 aa, Artificial Sequence
  Peptide Derived from Human Papillomavirus
LDCKWGVLILA

SEQ ID NO: 37416 - protein, 11 aa, Artificial Sequence
  Peptide Derived from Human Papillomavirus
LDDATHTCWTY

SEQ ID NO: 37417 - protein, 10 aa, Artificial Sequence
  Peptide Derived from Human Papillomavirus
LDGNPISIDR

SEQ ID NO: 37418 - protein, 11 aa, Artificial Sequence
  Peptide Derived from Human Papillomavirus
LDGNPISIDRK

SEQ ID NO: 37419 - protein, 10 aa, Artificial Sequence
  Peptide Derived from Human Papillomavirus
LDLHEDDEDA

SEQ ID NO: 37420 - protein, 11 aa, Artificial Sequence
  Peptide Derived from Human Papillomavirus
LFHAQEVQNDA

SEQ ID NO: 37421 - protein, 9 aa, Artificial Sequence
  Peptide Derived from Human Papillomavirus
LFTISDSGY

SEQ ID NO: 37422 - protein, 8 aa, Artificial Sequence
  Peptide Derived from Human Papillomavirus
LIEPPKLR

SEQ ID NO: 37423 - protein, 8 aa, Artificial Sequence
  Peptide Derived from Human Papillomavirus
LIKPATLY

SEQ ID NO: 37424 - protein, 9 aa, Artificial Sequence
  Peptide Derived from Human Papillomavirus
LIKPATLYA

SEQ ID NO: 37425 - protein, 10 aa, Artificial Sequence
  Peptide Derived from Human Papillomavirus
LIKPATLYAH

SEQ ID NO: 37426 - protein, 8 aa, Artificial Sequence
  Peptide Derived from Human Papillomavirus
LILALLRY

SEQ ID NO: 37427 - protein, 9 aa, Artificial Sequence
  Peptide Derived from Human Papillomavirus
LILALLRYK

SEQ ID NO: 37428 - protein, 11 aa, Artificial Sequence
  Peptide Derived from Human Papillomavirus
LLKRKFAGGSK

SEQ ID NO: 37429 - protein, 8 aa, Artificial Sequence
  Peptide Derived from Human Papillomavirus
LLQASNKK

SEQ ID NO: 37430 - protein, 9 aa, Artificial Sequence
  Peptide Derived from Human Papillomavirus
LLQASNKKA

SEQ ID NO: 37431 - protein, 10 aa, Artificial Sequence
  Peptide Derived from Human Papillomavirus
LLQASNKKAA

SEQ ID NO: 37432 - protein, 8 aa, Artificial Sequence
  Peptide Derived from Human Papillomavirus
LLRYKCGK

SEQ ID NO: 37433 - protein, 10 aa, Artificial Sequence
  Peptide Derived from Human Papillomavirus
LLRYKCGKNR

SEQ ID NO: 37434 - protein, 9 aa, Artificial Sequence
  Peptide Derived from Human Papillomavirus
LLTSNIDPA

SEQ ID NO: 37435 - protein, 10 aa, Artificial Sequence
  Peptide Derived from Human Papillomavirus
LLTSNIDPAK

SEQ ID NO: 37436 - protein, 10 aa, Artificial Sequence
  Peptide Derived from Human Papillomavirus
LLYGPANTGK

SEQ ID NO: 37437 - protein, 8 aa, Artificial Sequence
  Peptide Derived from Human Papillomavirus
LSDMVQWA

SEQ ID NO: 37438 - protein, 9 aa, Artificial Sequence
  Peptide Derived from Human Papillomavirus
LSDMVQWAF

SEQ ID NO: 37439 - protein, 8 aa, Artificial Sequence
  Peptide Derived from Human Papillomavirus
LSFTDLVR

SEQ ID NO: 37440 - protein, 10 aa, Artificial Sequence
  Peptide Derived from Human Papillomavirus
LSFTDLVRNF

SEQ ID NO: 37441 - protein, 11 aa, Artificial Sequence
  Peptide Derived from Human Papillomavirus
LSFTDLVRNFK

SEQ ID NO: 37442 - protein, 10 aa, Artificial Sequence
  Peptide Derived from Human Papillomavirus
LSVDTDLSPR

SEQ ID NO: 37443 - protein, 8 aa, Artificial Sequence
  Peptide Derived from Human Papillomavirus
LTDESDMA

SEQ ID NO: 37444 - protein, 9 aa, Artificial Sequence
  Peptide Derived from Human Papillomavirus
LTDESDMAF

SEQ ID NO: 37445 - protein, 11 aa, Artificial Sequence
  Peptide Derived from Human Papillomavirus
LTDESDMAFQY

SEQ ID NO: 37446 - protein, 8 aa, Artificial Sequence
  Peptide Derived from Human Papillomavirus
LTSNIDPA

SEQ ID NO: 37447 - protein, 9 aa, Artificial Sequence
  Peptide Derived from Human Papillomavirus
LTSNIDPAK

SEQ ID NO: 37448 - protein, 9 aa, Artificial Sequence
  Peptide Derived from Human Papillomavirus
LVRNFKSDK

SEQ ID NO: 37449 - protein, 9 aa, Artificial Sequence
  Peptide Derived from Human Papillomavirus
MAFQYAQLA

SEQ ID NO: 37450 - protein, 11 aa, Artificial Sequence
  Peptide Derived from Human Papillomavirus
MAIFGVNPTVA

SEQ ID NO: 37451 - protein, 8 aa, Artificial Sequence
  Peptide Derived from Human Papillomavirus
MCRHYKRA

SEQ ID NO: 37452 - protein, 10 aa, Artificial Sequence
  Peptide Derived from Human Papillomavirus
MCRHYKRAQK

SEQ ID NO: 37453 - protein, 11 aa, Artificial Sequence
  Peptide Derived from Human Papillomavirus
MCRHYKRAQKR

SEQ ID NO: 37454 - protein, 9 aa, Artificial Sequence
  Peptide Derived from Human Papillomavirus
MLAVFKDIY

SEQ ID NO: 37455 - protein, 9 aa, Artificial Sequence
  Peptide Derived from Human Papillomavirus
MLIEPPKLR

SEQ ID NO: 37456 - protein, 10 aa, Artificial Sequence
  Peptide Derived from Human Papillomavirus
MSFIHFLQGA

SEQ ID NO: 37457 - protein, 8 aa, Artificial Sequence
  Peptide Derived from Human Papillomavirus
MSQWIKYR

SEQ ID NO: 37458 - protein, 11 aa, Artificial Sequence
  Peptide Derived from Human Papillomavirus
MSQWIKYRCSK

SEQ ID NO: 37459 - protein, 9 aa, Artificial Sequence
  Peptide Derived from Human Papillomavirus
NAENGGSVH

SEQ ID NO: 37460 - protein, 8 aa, Artificial Sequence
  Peptide Derived from Human Papillomavirus
NAENVDPH

SEQ ID NO: 37461 - protein, 9 aa, Artificial Sequence
  Peptide Derived from Human Papillomavirus
NCILLYGPA

SEQ ID NO: 37462 - protein, 8 aa, Artificial Sequence
  Peptide Derived from Human Papillomavirus
NCQAKYLK

SEQ ID NO: 37463 - protein, 11 aa, Artificial Sequence
  Peptide Derived from Human Papillomavirus
NCQAKYLKDCA

SEQ ID NO: 37464 - protein, 10 aa, Artificial Sequence
  Peptide Derived from Human Papillomavirus
NDAQVLHLLK

SEQ ID NO: 37465 - protein, 11 aa, Artificial Sequence
  Peptide Derived from Human Papillomavirus
NDAQVLHLLKR

SEQ ID NO: 37466 - protein, 8 aa, Artificial Sequence
  Peptide Derived from Human Papillomavirus
NDKNWKCF

SEQ ID NO: 37467 - protein, 9 aa, Artificial Sequence
  Peptide Derived from Human Papillomavirus
NDKNWKCFF

SEQ ID NO: 37468 - protein, 11 aa, Artificial Sequence
  Peptide Derived from Human Papillomavirus
NDKNWKCFFER

SEQ ID NO: 37469 - protein, 10 aa, Artificial Sequence
  Peptide Derived from Human Papillomavirus
NDLTDESDMA

SEQ ID NO: 37470 - protein, 11 aa, Artificial Sequence
  Peptide Derived from Human Papillomavirus
NDLTDESDMAF

SEQ ID NO: 37471 - protein, 11 aa, Artificial Sequence
  Peptide Derived from Human Papillomavirus
NFDLSDMVQWA

SEQ ID NO: 37472 - protein, 11 aa, Artificial Sequence
  Peptide Derived from Human Papillomavirus
NGNPVYEINDK

SEQ ID NO: 37473 - protein, 9 aa, Artificial Sequence
  Peptide Derived from Human Papillomavirus
NIDPAKDNK

SEQ ID NO: 37474 - protein, 8 aa, Artificial Sequence
  Peptide Derived from Human Papillomavirus
NMSQWIKY

SEQ ID NO: 37475 - protein, 9 aa, Artificial Sequence
  Peptide Derived from Human Papillomavirus
NMSQWIKYR

SEQ ID NO: 37476 - protein, 8 aa, Artificial Sequence
  Peptide Derived from Human Papillomavirus
NSGHKKAK

SEQ ID NO: 37477 - protein, 9 aa, Artificial Sequence
  Peptide Derived from Human Papillomavirus
NSGHKKAKR

SEQ ID NO: 37478 - protein, 10 aa, Artificial Sequence
  Peptide Derived from Human Papillomavirus
NSGHKKAKRR

SEQ ID NO: 37479 - protein, 10 aa, Artificial Sequence
  Peptide Derived from Human Papillomavirus
NSHFWLEPLA

SEQ ID NO: 37480 - protein, 9 aa, Artificial Sequence
  Peptide Derived from Human Papillomavirus
NSNAAAFLK

SEQ ID NO: 37481 - protein, 11 aa, Artificial Sequence
  Peptide Derived from Human Papillomavirus
NTGKSYFGMSF

SEQ ID NO: 37482 - protein, 11 aa, Artificial Sequence
  Peptide Derived from Human Papillomavirus
NTNAENGGSVH

SEQ ID NO: 37483 - protein, 9 aa, Artificial Sequence
  Peptide Derived from Human Papillomavirus
PAKDNKWPY

SEQ ID NO: 37484 - protein, 8 aa, Artificial Sequence
  Peptide Derived from Human Papillomavirus
PANTGKSY

SEQ ID NO: 37485 - protein, 9 aa, Artificial Sequence
  Peptide Derived from Human Papillomavirus
PANTGKSYF

SEQ ID NO: 37486 - protein, 10 aa, Artificial Sequence
  Peptide Derived from Human Papillomavirus
PFDKNGNPVY

SEQ ID NO: 37487 - protein, 11 aa, Artificial Sequence
  Peptide Derived from Human Papillomavirus
PILLTSNIDPA

SEQ ID NO: 37488 - protein, 8 aa, Artificial Sequence
  Peptide Derived from Human Papillomavirus
PISIDRKH

SEQ ID NO: 37489 - protein, 9 aa, Artificial Sequence
  Peptide Derived from Human Papillomavirus
PISIDRKHK

SEQ ID NO: 37490 - protein, 8 aa, Artificial Sequence
  Peptide Derived from Human Papillomavirus
PIVQFLRY

SEQ ID NO: 37491 - protein, 8 aa, Artificial Sequence
  Peptide Derived from Human Papillomavirus
PLADTKVA

SEQ ID NO: 37492 - protein, 8 aa, Artificial Sequence
  Peptide Derived from Human Papillomavirus
PTVAEGFK

SEQ ID NO: 37493 - protein, 8 aa, Artificial Sequence
  Peptide Derived from Human Papillomavirus
PVYEINDK

SEQ ID NO: 37494 - protein, 11 aa, Artificial Sequence
  Peptide Derived from Human Papillomavirus
PVYEINDKNWK

SEQ ID NO: 37495 - protein, 9 aa, Artificial Sequence
  Peptide Derived from Human Papillomavirus
QAEQETAQA

SEQ ID NO: 37496 - protein, 11 aa, Artificial Sequence
  Peptide Derived from Human Papillomavirus
QAEQETAQALF

SEQ ID NO: 37497 - protein, 9 aa, Artificial Sequence
  Peptide Derived from Human Papillomavirus
QAKYLKDCA

SEQ ID NO: 37498 - protein, 8 aa, Artificial Sequence
  Peptide Derived from Human Papillomavirus
QASNKKAA

SEQ ID NO: 37499 - protein, 11 aa, Artificial Sequence
  Peptide Derived from Human Papillomavirus
QASNKKAAMLA

SEQ ID NO: 37500 - protein, 10 aa, Artificial Sequence
  Peptide Derived from Human Papillomavirus
QFLRYQGVEF

SEQ ID NO: 37501 - protein, 8 aa, Artificial Sequence
  Peptide Derived from Human Papillomavirus
QGVEFISF

SEQ ID NO: 37502 - protein, 10 aa, Artificial Sequence
  Peptide Derived from Human Papillomavirus
QGVEFISFLR

SEQ ID NO: 37503 - protein, 11 aa, Artificial Sequence
  Peptide Derived from Human Papillomavirus
QGVEFISFLRA

SEQ ID NO: 37504 - protein, 9 aa, Artificial Sequence
  Peptide Derived from Human Papillomavirus
QLADCNSNA

SEQ ID NO: 37505 - protein, 10 aa, Artificial Sequence
  Peptide Derived from Human Papillomavirus
QLADCNSNAA

SEQ ID NO: 37506 - protein, 11 aa, Artificial Sequence
  Peptide Derived from Human Papillomavirus
QLADCNSNAAA

SEQ ID NO: 37507 - protein, 8 aa, Artificial Sequence
  Peptide Derived from Human Papillomavirus
QLSICEQA

SEQ ID NO: 37508 - protein, 11 aa, Artificial Sequence
  Peptide Derived from Human Papillomavirus
QLSVDTDLSPR

SEQ ID NO: 37509 - protein, 9 aa, Artificial Sequence
  Peptide Derived from Human Papillomavirus
QMNMSQWIK

SEQ ID NO: 37510 - protein, 10 aa, Artificial Sequence
  Peptide Derived from Human Papillomavirus
QMNMSQWIKY

SEQ ID NO: 37511 - protein, 11 aa, Artificial Sequence
  Peptide Derived from Human Papillomavirus
QMNMSQWIKYR

SEQ ID NO: 37512 - protein, 11 aa, Artificial Sequence
  Peptide Derived from Human Papillomavirus
QSSGGDSSDNA

SEQ ID NO: 37513 - protein, 8 aa, Artificial Sequence
  Peptide Derived from Human Papillomavirus
QVLHLLKR

SEQ ID NO: 37514 - protein, 9 aa, Artificial Sequence
  Peptide Derived from Human Papillomavirus
QVLHLLKRK

SEQ ID NO: 37515 - protein, 10 aa, Artificial Sequence
  Peptide Derived from Human Papillomavirus
QVLHLLKRKF

SEQ ID NO: 37516 - protein, 11 aa, Artificial Sequence
  Peptide Derived from Human Papillomavirus
QVLHLLKRKFA

SEQ ID NO: 37517 - protein, 8 aa, Artificial Sequence
  Peptide Derived from Human Papillomavirus
QVTVNTNA

SEQ ID NO: 37518 - protein, 8 aa, Artificial Sequence
  Peptide Derived from Human Papillomavirus
RALKEFLK

SEQ ID NO: 37519 - protein, 11 aa, Artificial Sequence
  Peptide Derived from Human Papillomavirus
RLDLHEDDEDA

SEQ ID NO: 37520 - protein, 10 aa, Artificial Sequence
  Peptide Derived from Human Papillomavirus
RLFTISDSGY

SEQ ID NO: 37521 - protein, 11 aa, Artificial Sequence
  Peptide Derived from Human Papillomavirus
RLQEISLNSGH

SEQ ID NO: 37522 - protein, 8 aa, Artificial Sequence
  Peptide Derived from Human Papillomavirus
RSSVAALY

SEQ ID NO: 37523 - protein, 10 aa, Artificial Sequence
  Peptide Derived from Human Papillomavirus
RSSVAALYWY

SEQ ID NO: 37524 - protein, 11 aa, Artificial Sequence
  Peptide Derived from Human Papillomavirus
RSSVAALYWYR

SEQ ID NO: 37525 - protein, 9 aa, Artificial Sequence
  Peptide Derived from Human Papillomavirus
RTWSRLDLH

SEQ ID NO: 37526 - protein, 9 aa, Artificial Sequence
  Peptide Derived from Human Papillomavirus
RVTVFTFPH

SEQ ID NO: 37527 - protein, 10 aa, Artificial Sequence
  Peptide Derived from Human Papillomavirus
RVTVFTFPHA

SEQ ID NO: 37528 - protein, 11 aa, Artificial Sequence
  Peptide Derived from Human Papillomavirus
RVTVFTFPHAF

SEQ ID NO: 37529 - protein, 8 aa, Artificial Sequence
  Peptide Derived from Human Papillomavirus
SDDEDETA

SEQ ID NO: 37530 - protein, 8 aa, Artificial Sequence
  Peptide Derived from Human Papillomavirus
SDMAFQYA

SEQ ID NO: 37531 - protein, 11 aa, Artificial Sequence
  Peptide Derived from Human Papillomavirus
SDMAFQYAQLA

SEQ ID NO: 37532 - protein, 8 aa, Artificial Sequence
  Peptide Derived from Human Papillomavirus
SDMVQWAF

SEQ ID NO: 37533 - protein, 10 aa, Artificial Sequence
  Peptide Derived from Human Papillomavirus
SDNAENVDPH

SEQ ID NO: 37534 - protein, 9 aa, Artificial Sequence
  Peptide Derived from Human Papillomavirus
SFIHFLQGA

SEQ ID NO: 37535 - protein, 9 aa, Artificial Sequence
  Peptide Derived from Human Papillomavirus
SFLRALKEF

SEQ ID NO: 37536 - protein, 11 aa, Artificial Sequence
  Peptide Derived from Human Papillomavirus
SFLRALKEFLK

SEQ ID NO: 37537 - protein, 9 aa, Artificial Sequence
  Peptide Derived from Human Papillomavirus
SFTDLVRNF

SEQ ID NO: 37538 - protein, 10 aa, Artificial Sequence
  Peptide Derived from Human Papillomavirus
SFTDLVRNFK

SEQ ID NO: 37539 - protein, 8 aa, Artificial Sequence
  Peptide Derived from Human Papillomavirus
SFVNSNSH

SEQ ID NO: 37540 - protein, 9 aa, Artificial Sequence
  Peptide Derived from Human Papillomavirus
SFVNSNSHF

SEQ ID NO: 37541 - protein, 10 aa, Artificial Sequence
  Peptide Derived from Human Papillomavirus
SGDTPEWIQR

SEQ ID NO: 37542 - protein, 9 aa, Artificial Sequence
  Peptide Derived from Human Papillomavirus
SGGDSSDNA

SEQ ID NO: 37543 - protein, 8 aa, Artificial Sequence
  Peptide Derived from Human Papillomavirus
SGHKKAKR

SEQ ID NO: 37544 - protein, 9 aa, Artificial Sequence
  Peptide Derived from Human Papillomavirus
SGHKKAKRR

SEQ ID NO: 37545 - protein, 11 aa, Artificial Sequence
  Peptide Derived from Human Papillomavirus
SGHKKAKRRLF

SEQ ID NO: 37546 - protein, 10 aa, Artificial Sequence
  Peptide Derived from Human Papillomavirus
SGYGCSEVEA

SEQ ID NO: 37547 - protein, 11 aa, Artificial Sequence
  Peptide Derived from Human Papillomavirus
SGYGCSEVEAA

SEQ ID NO: 37548 - protein, 11 aa, Artificial Sequence
  Peptide Derived from Human Papillomavirus
SICEQAEQETA

SEQ ID NO: 37549 - protein, 11 aa, Artificial Sequence
  Peptide Derived from Human Papillomavirus
SITELKELLQA

SEQ ID NO: 37550 - protein, 8 aa, Artificial Sequence
  Peptide Derived from Human Papillomavirus
SLNSGHKK

SEQ ID NO: 37551 - protein, 9 aa, Artificial Sequence
  Peptide Derived from Human Papillomavirus
SLNSGHKKA

SEQ ID NO: 37552 - protein, 10 aa, Artificial Sequence
  Peptide Derived from Human Papillomavirus
SLNSGHKKAK

SEQ ID NO: 37553 - protein, 11 aa, Artificial Sequence
  Peptide Derived from Human Papillomavirus
SLNSGHKKAKR

SEQ ID NO: 37554 - protein, 11 aa, Artificial Sequence
  Peptide Derived from Human Papillomavirus
SSDNAENVDPH

SEQ ID NO: 37555 - protein, 10 aa, Artificial Sequence
  Peptide Derived from Human Papillomavirus
SSGGDSSDNA

SEQ ID NO: 37556 - protein, 9 aa, Artificial Sequence
  Peptide Derived from Human Papillomavirus
SSVAALYWY

SEQ ID NO: 37557 - protein, 10 aa, Artificial Sequence
  Peptide Derived from Human Papillomavirus
SSVAALYWYR

SEQ ID NO: 37558 - protein, 8 aa, Artificial Sequence
  Peptide Derived from Human Papillomavirus
SVAALYWY

SEQ ID NO: 37559 - protein, 9 aa, Artificial Sequence
  Peptide Derived from Human Papillomavirus
SVAALYWYR

SEQ ID NO: 37560 - protein, 9 aa, Artificial Sequence
  Peptide Derived from Human Papillomavirus
SVDTDLSPR

SEQ ID NO: 37561 - protein, 8 aa, Artificial Sequence
  Peptide Derived from Human Papillomavirus
TAQALFHA

SEQ ID NO: 37562 - protein, 9 aa, Artificial Sequence
  Peptide Derived from Human Papillomavirus
TCMLIEPPK

SEQ ID NO: 37563 - protein, 11 aa, Artificial Sequence
  Peptide Derived from Human Papillomavirus
TCMLIEPPKLR

SEQ ID NO: 37564 - protein, 8 aa, Artificial Sequence
  Peptide Derived from Human Papillomavirus
TCTDWVMA

SEQ ID NO: 37565 - protein, 10 aa, Artificial Sequence
  Peptide Derived from Human Papillomavirus
TCTDWVMAIF

SEQ ID NO: 37566 - protein, 9 aa, Artificial Sequence
  Peptide Derived from Human Papillomavirus
TCWTYFDNY

SEQ ID NO: 37567 - protein, 11 aa, Artificial Sequence
  Peptide Derived from Human Papillomavirus
TCWTYFDNYMR

SEQ ID NO: 37568 - protein, 8 aa, Artificial Sequence
  Peptide Derived from Human Papillomavirus
TDESDMAF

SEQ ID NO: 37569 - protein, 10 aa, Artificial Sequence
  Peptide Derived from Human Papillomavirus
TDESDMAFQY

SEQ ID NO: 37570 - protein, 11 aa, Artificial Sequence
  Peptide Derived from Human Papillomavirus
TDESDMAFQYA

SEQ ID NO: 37571 - protein, 8 aa, Artificial Sequence
  Peptide Derived from Human Papillomavirus
TDLVRNFK

SEQ ID NO: 37572 - protein, 11 aa, Artificial Sequence
  Peptide Derived from Human Papillomavirus
TDLVRNFKSDK

SEQ ID NO: 37573 - protein, 10 aa, Artificial Sequence
  Peptide Derived from Human Papillomavirus
TDTGSDMVDF

SEQ ID NO: 37574 - protein, 8 aa, Artificial Sequence
  Peptide Derived from Human Papillomavirus
TDWVMAIF

SEQ ID NO: 37575 - protein, 11 aa, Artificial Sequence
  Peptide Derived from Human Papillomavirus
TFKCVTGQNTR

SEQ ID NO: 37576 - protein, 8 aa, Artificial Sequence
  Peptide Derived from Human Papillomavirus
TFPHAFPF

SEQ ID NO: 37577 - protein, 10 aa, Artificial Sequence
  Peptide Derived from Human Papillomavirus
TFPHAFPFDK

SEQ ID NO: 37578 - protein, 8 aa, Artificial Sequence
  Peptide Derived from Human Papillomavirus
TGCNGWFF

SEQ ID NO: 37579 - protein, 10 aa, Artificial Sequence
  Peptide Derived from Human Papillomavirus
TGKSYFGMSF

SEQ ID NO: 37580 - protein, 8 aa, Artificial Sequence
  Peptide Derived from Human Papillomavirus
TGSDMVDF

SEQ ID NO: 37581 - protein, 9 aa, Artificial Sequence
  Peptide Derived from Human Papillomavirus
TLIKPATLY

SEQ ID NO: 37582 - protein, 10 aa, Artificial Sequence
  Peptide Derived from Human Papillomavirus
TLIKPATLYA

SEQ ID NO: 37583 - protein, 11 aa, Artificial Sequence
  Peptide Derived from Human Papillomavirus
TLIKPATLYAH

SEQ ID NO: 37584 - protein, 8 aa, Artificial Sequence
  Peptide Derived from Human Papillomavirus
TSNIDPAK

SEQ ID NO: 37585 - protein, 11 aa, Artificial Sequence
  Peptide Derived from Human Papillomavirus
TSNIDPAKDNK

SEQ ID NO: 37586 - protein, 9 aa, Artificial Sequence
  Peptide Derived from Human Papillomavirus
TTCTDWVMA

SEQ ID NO: 37587 - protein, 11 aa, Artificial Sequence
  Peptide Derived from Human Papillomavirus
TTCTDWVMAIF

SEQ ID NO: 37588 - protein, 11 aa, Artificial Sequence
  Peptide Derived from Human Papillomavirus
TVAEGFKTLIK

SEQ ID NO: 37589 - protein, 11 aa, Artificial Sequence
  Peptide Derived from Human Papillomavirus
TVAKGLSTLLH

SEQ ID NO: 37590 - protein, 8 aa, Artificial Sequence
  Peptide Derived from Human Papillomavirus
TVFTFPHA

SEQ ID NO: 37591 - protein, 9 aa, Artificial Sequence
  Peptide Derived from Human Papillomavirus
TVFTFPHAF

SEQ ID NO: 37592 - protein, 11 aa, Artificial Sequence
  Peptide Derived from Human Papillomavirus
TVFTFPHAFPF

SEQ ID NO: 37593 - protein, 8 aa, Artificial Sequence
  Peptide Derived from Human Papillomavirus
VAALYWYR

SEQ ID NO: 37594 - protein, 10 aa, Artificial Sequence
  Peptide Derived from Human Papillomavirus
VAEGFKTLIK

SEQ ID NO: 37595 - protein, 10 aa, Artificial Sequence
  Peptide Derived from Human Papillomavirus
VAKGLSTLLH

SEQ ID NO: 37596 - protein, 9 aa, Artificial Sequence
  Peptide Derived from Human Papillomavirus
VAMLDDATH

SEQ ID NO: 37597 - protein, 11 aa, Artificial Sequence
  Peptide Derived from Human Papillomavirus
VDPHCSITELK

SEQ ID NO: 37598 - protein, 8 aa, Artificial Sequence
  Peptide Derived from Human Papillomavirus
VDTDLSPR

SEQ ID NO: 37599 - protein, 10 aa, Artificial Sequence
  Peptide Derived from Human Papillomavirus
VFKDIYGLSF

SEQ ID NO: 37600 - protein, 8 aa, Artificial Sequence
  Peptide Derived from Human Papillomavirus
VFTFPHAF

SEQ ID NO: 37601 - protein, 10 aa, Artificial Sequence
  Peptide Derived from Human Papillomavirus
VFTFPHAFPF

SEQ ID NO: 37602 - protein, 10 aa, Artificial Sequence
  Peptide Derived from Human Papillomavirus
VISDDEDETA

SEQ ID NO: 37603 - protein, 8 aa, Artificial Sequence
  Peptide Derived from Human Papillomavirus
VLHLLKRK

SEQ ID NO: 37604 - protein, 9 aa, Artificial Sequence
  Peptide Derived from Human Papillomavirus
VLHLLKRKF

SEQ ID NO: 37605 - protein, 10 aa, Artificial Sequence
  Peptide Derived from Human Papillomavirus
VLHLLKRKFA

SEQ ID NO: 37606 - protein, 8 aa, Artificial Sequence
  Peptide Derived from Human Papillomavirus
VLILALLR

SEQ ID NO: 37607 - protein, 9 aa, Artificial Sequence
  Peptide Derived from Human Papillomavirus
VLILALLRY

SEQ ID NO: 37608 - protein, 10 aa, Artificial Sequence
  Peptide Derived from Human Papillomavirus
VLILALLRYK

SEQ ID NO: 37609 - protein, 8 aa, Artificial Sequence
  Peptide Derived from Human Papillomavirus
VMCRHYKR

SEQ ID NO: 37610 - protein, 9 aa, Artificial Sequence
  Peptide Derived from Human Papillomavirus
VMCRHYKRA

SEQ ID NO: 37611 - protein, 11 aa, Artificial Sequence
  Peptide Derived from Human Papillomavirus
VMCRHYKRAQK

SEQ ID NO: 37612 - protein, 11 aa, Artificial Sequence
  Peptide Derived from Human Papillomavirus
VSGDTPEWIQR

SEQ ID NO: 37613 - protein, 8 aa, Artificial Sequence
  Peptide Derived from Human Papillomavirus
VTVFTFPH

SEQ ID NO: 37614 - protein, 9 aa, Artificial Sequence
  Peptide Derived from Human Papillomavirus
VTVFTFPHA

SEQ ID NO: 37615 - protein, 10 aa, Artificial Sequence
  Peptide Derived from Human Papillomavirus
VTVFTFPHAF

SEQ ID NO: 37616 - protein, 10 aa, Artificial Sequence
  Peptide Derived from Human Papillomavirus
WFFVETIVEK

SEQ ID NO: 37617 - protein, 11 aa, Artificial Sequence
  Peptide Derived from Human Papillomavirus
WFFVETIVEKK

SEQ ID NO: 37618 - protein, 10 aa, Artificial Sequence
  Peptide Derived from Human Papillomavirus
WGVLILALLR

SEQ ID NO: 37619 - protein, 11 aa, Artificial Sequence
  Peptide Derived from Human Papillomavirus
WGVLILALLRY

SEQ ID NO: 37620 - protein, 8 aa, Artificial Sequence
  Peptide Derived from Human Papillomavirus
WIKYRCSK

SEQ ID NO: 37621 - protein, 10 aa, Artificial Sequence
  Peptide Derived from Human Papillomavirus
WIQRLTIIQH

SEQ ID NO: 37622 - protein, 9 aa, Artificial Sequence
  Peptide Derived from Human Papillomavirus
WLEPLADTK

SEQ ID NO: 37623 - protein, 11 aa, Artificial Sequence
  Peptide Derived from Human Papillomavirus
WLEPLADTKVA

SEQ ID NO: 37624 - protein, 9 aa, Artificial Sequence
  Peptide Derived from Human Papillomavirus
WTYFDNYMR

SEQ ID NO: 37625 - protein, 11 aa, Artificial Sequence
  Peptide Derived from Human Papillomavirus
WTYFDNYMRNA

SEQ ID NO: 37626 - protein, 10 aa, Artificial Sequence
  Peptide Derived from Human Papillomavirus
YAHIQCLDCK

SEQ ID NO: 37627 - protein, 11 aa, Artificial Sequence
  Peptide Derived from Human Papillomavirus
YAQLADCNSNA

SEQ ID NO: 37628 - protein, 9 aa, Artificial Sequence
  Peptide Derived from Human Papillomavirus
YFDNYMRNA

SEQ ID NO: 37629 - protein, 8 aa, Artificial Sequence
  Peptide Derived from Human Papillomavirus
YFGMSFIH

SEQ ID NO: 37630 - protein, 9 aa, Artificial Sequence
  Peptide Derived from Human Papillomavirus
YFGMSFIHF

SEQ ID NO: 37631 - protein, 8 aa, Artificial Sequence
  Peptide Derived from Human Papillomavirus
YGCSEVEA

SEQ ID NO: 37632 - protein, 9 aa, Artificial Sequence
  Peptide Derived from Human Papillomavirus
YGCSEVEAA

SEQ ID NO: 37633 - protein, 10 aa, Artificial Sequence
  Peptide Derived from Human Papillomavirus
YGLSFTDLVR

SEQ ID NO: 37634 - protein, 8 aa, Artificial Sequence
  Peptide Derived from Human Papillomavirus
YGPANTGK

SEQ ID NO: 37635 - protein, 10 aa, Artificial Sequence
  Peptide Derived from Human Papillomavirus
YGPANTGKSY

SEQ ID NO: 37636 - protein, 11 aa, Artificial Sequence
  Peptide Derived from Human Papillomavirus
YGPANTGKSYF

SEQ ID NO: 37637 - protein, 9 aa, Artificial Sequence
  Peptide Derived from Human Papillomavirus
YLESRVTVF

SEQ ID NO: 37638 - protein, 11 aa, Artificial Sequence
  Peptide Derived from Human Papillomavirus
YLESRVTVFTF

SEQ ID NO: 37639 - protein, 10 aa, Artificial Sequence
  Peptide Derived from Human Papillomavirus
YLKDCAVMCR

SEQ ID NO: 37640 - protein, 11 aa, Artificial Sequence
  Peptide Derived from Human Papillomavirus
YLKDCAVMCRH

SEQ ID NO: 37641 - protein, 10 aa, Artificial Sequence
  Peptide Derived from Human Papillomavirus
AACVSYWGVY

SEQ ID NO: 37642 - protein, 11 aa, Artificial Sequence
  Peptide Derived from Human Papillomavirus
AACVSYWGVYY

SEQ ID NO: 37643 - protein, 9 aa, Artificial Sequence
  Peptide Derived from Human Papillomavirus
ACVSYWGVY

SEQ ID NO: 37644 - protein, 10 aa, Artificial Sequence
  Peptide Derived from Human Papillomavirus
ACVSYWGVYY

SEQ ID NO: 37645 - protein, 9 aa, Artificial Sequence
  Peptide Derived from Human Papillomavirus
AIELQMALK

SEQ ID NO: 37646 - protein, 9 aa, Artificial Sequence
  Peptide Derived from Human Papillomavirus
AILFTAREH

SEQ ID NO: 37647 - protein, 9 aa, Artificial Sequence
  Peptide Derived from Human Papillomavirus
ALKGLAQSK

SEQ ID NO: 37648 - protein, 10 aa, Artificial Sequence
  Peptide Derived from Human Papillomavirus
ALKGLAQSKY

SEQ ID NO: 37649 - protein, 9 aa, Artificial Sequence
  Peptide Derived from Human Papillomavirus
ALQDKILDH

SEQ ID NO: 37650 - protein, 10 aa, Artificial Sequence
  Peptide Derived from Human Papillomavirus
ALQDKILDHY

SEQ ID NO: 37651 - protein, 9 aa, Artificial Sequence
  Peptide Derived from Human Papillomavirus
ASTSTPKTA

SEQ ID NO: 37652 - protein, 9 aa, Artificial Sequence
  Peptide Derived from Human Papillomavirus
ASVGTPKPH

SEQ ID NO: 37653 - protein, 10 aa, Artificial Sequence
  Peptide Derived from Human Papillomavirus
ATQIVRQLQH

SEQ ID NO: 37654 - protein, 11 aa, Artificial Sequence
  Peptide Derived from Human Papillomavirus
ATQIVRQLQHA

SEQ ID NO: 37655 - protein, 10 aa, Artificial Sequence
  Peptide Derived from Human Papillomavirus
CFKKGGKTVH

SEQ ID NO: 37656 - protein, 8 aa, Artificial Sequence
  Peptide Derived from Human Papillomavirus
CGLTEQHH

SEQ ID NO: 37657 - protein, 10 aa, Artificial Sequence
  Peptide Derived from Human Papillomavirus
CGLTEQHHGR

SEQ ID NO: 37658 - protein, 8 aa, Artificial Sequence
  Peptide Derived from Human Papillomavirus
CLRYRLRK

SEQ ID NO: 37659 - protein, 9 aa, Artificial Sequence
  Peptide Derived from Human Papillomavirus
CLRYRLRKY

SEQ ID NO: 37660 - protein, 10 aa, Artificial Sequence
  Peptide Derived from Human Papillomavirus
CLRYRLRKYA

SEQ ID NO: 37661 - protein, 11 aa, Artificial Sequence
  Peptide Derived from Human Papillomavirus
CMNYVVWDSIY

SEQ ID NO: 37662 - protein, 10 aa, Artificial Sequence
  Peptide Derived from Human Papillomavirus
CSGNTTPIIH

SEQ ID NO: 37663 - protein, 8 aa, Artificial Sequence
  Peptide Derived from Human Papillomavirus
CSSTSNNK

SEQ ID NO: 37664 - protein, 9 aa, Artificial Sequence
  Peptide Derived from Human Papillomavirus
CSSTSNNKR

SEQ ID NO: 37665 - protein, 10 aa, Artificial Sequence
  Peptide Derived from Human Papillomavirus
CSSTSNNKRR

SEQ ID NO: 37666 - protein, 11 aa, Artificial Sequence
  Peptide Derived from Human Papillomavirus
CSSTSNNKRRK

SEQ ID NO: 37667 - protein, 10 aa, Artificial Sequence
  Peptide Derived from Human Papillomavirus
CSTSDDTVSA

SEQ ID NO: 37668 - protein, 8 aa, Artificial Sequence
  Peptide Derived from Human Papillomavirus
CVSYWGVY

SEQ ID NO: 37669 - protein, 9 aa, Artificial Sequence
  Peptide Derived from Human Papillomavirus
CVSYWGVYY

SEQ ID NO: 37670 - protein, 11 aa, Artificial Sequence
  Peptide Derived from Human Papillomavirus
CVSYWGVYYIK

SEQ ID NO: 37671 - protein, 11 aa, Artificial Sequence
  Peptide Derived from Human Papillomavirus
DDTVSATQIVR

SEQ ID NO: 37672 - protein, 10 aa, Artificial Sequence
  Peptide Derived from Human Papillomavirus
DGDTTYYVQF

SEQ ID NO: 37673 - protein, 11 aa, Artificial Sequence
  Peptide Derived from Human Papillomavirus
DGDTTYYVQFK

SEQ ID NO: 37674 - protein, 10 aa, Artificial Sequence
  Peptide Derived from Human Papillomavirus
DGNKDNCMNY

SEQ ID NO: 37675 - protein, 8 aa, Artificial Sequence
  Peptide Derived from Human Papillomavirus
DINSQISY

SEQ ID NO: 37676 - protein, 11 aa, Artificial Sequence
  Peptide Derived from Human Papillomavirus
DSKDINSQISY

SEQ ID NO: 37677 - protein, 8 aa, Artificial Sequence
  Peptide Derived from Human Papillomavirus
DTTYYVQF

SEQ ID NO: 37678 - protein, 9 aa, Artificial Sequence
  Peptide Derived from Human Papillomavirus
DTTYYVQFK

SEQ ID NO: 37679 - protein, 10 aa, Artificial Sequence
  Peptide Derived from Human Papillomavirus
DTVSATQIVR

SEQ ID NO: 37680 - protein, 10 aa, Artificial Sequence
  Peptide Derived from Human Papillomavirus
ELQMALKGLA

SEQ ID NO: 37681 - protein, 11 aa, Artificial Sequence
  Peptide Derived from Human Papillomavirus
ELWNTEPSQCF

SEQ ID NO: 37682 - protein, 9 aa, Artificial Sequence
  Peptide Derived from Human Papillomavirus
ESLSERLSA

SEQ ID NO: 37683 - protein, 9 aa, Artificial Sequence
  Peptide Derived from Human Papillomavirus
ETGIWDKTA

SEQ ID NO: 37684 - protein, 10 aa, Artificial Sequence
  Peptide Derived from Human Papillomavirus
ETGIWDKTAA

SEQ ID NO: 37685 - protein, 11 aa, Artificial Sequence
  Peptide Derived from Human Papillomavirus
FDGNKDNCMNY

SEQ ID NO: 37686 - protein, 10 aa, Artificial Sequence
  Peptide Derived from Human Papillomavirus
FTAREHGITK

SEQ ID NO: 37687 - protein, 10 aa, Artificial Sequence
  Peptide Derived from Human Papillomavirus
GDKNSLKCLR

SEQ ID NO: 37688 - protein, 11 aa, Artificial Sequence
  Peptide Derived from Human Papillomavirus
GDKNSLKCLRY

SEQ ID NO: 37689 - protein, 9 aa, Artificial Sequence
  Peptide Derived from Human Papillomavirus
GDTTYYVQF

SEQ ID NO: 37690 - protein, 10 aa, Artificial Sequence
  Peptide Derived from Human Papillomavirus
GDTTYYVQFK

SEQ ID NO: 37691 - protein, 8 aa, Artificial Sequence
  Peptide Derived from Human Papillomavirus
GGKTVHVY

SEQ ID NO: 37692 - protein, 9 aa, Artificial Sequence
  Peptide Derived from Human Papillomavirus
GGKTVHVYF

SEQ ID NO: 37693 - protein, 8 aa, Artificial Sequence
  Peptide Derived from Human Papillomavirus
GIWDKTAA

SEQ ID NO: 37694 - protein, 9 aa, Artificial Sequence
  Peptide Derived from Human Papillomavirus
GLTEQHHGR

SEQ ID NO: 37695 - protein, 11 aa, Artificial Sequence
  Peptide Derived from Human Papillomavirus
GTPKPHIQTPA

SEQ ID NO: 37696 - protein, 8 aa, Artificial Sequence
  Peptide Derived from Human Papillomavirus
HASTSTPK

SEQ ID NO: 37697 - protein, 10 aa, Artificial Sequence
  Peptide Derived from Human Papillomavirus
HASTSTPKTA

SEQ ID NO: 37698 - protein, 8 aa, Artificial Sequence
  Peptide Derived from Human Papillomavirus
HGITKLNH

SEQ ID NO: 37699 - protein, 9 aa, Artificial Sequence
  Peptide Derived from Human Papillomavirus
HGRVNTHVH

SEQ ID NO: 37700 - protein, 8 aa, Artificial Sequence
  Peptide Derived from Human Papillomavirus
HIQTPATK

SEQ ID NO: 37701 - protein, 9 aa, Artificial Sequence
  Peptide Derived from Human Papillomavirus
HIQTPATKR

SEQ ID NO: 37702 - protein, 11 aa, Artificial Sequence
  Peptide Derived from Human Papillomavirus
HIQTPATKRPR

SEQ ID NO: 37703 - protein, 10 aa, Artificial Sequence
  Peptide Derived from Human Papillomavirus
HLKGDKNSLK

SEQ ID NO: 37704 - protein, 8 aa, Artificial Sequence
  Peptide Derived from Human Papillomavirus
HVYFDGNK

SEQ ID NO: 37705 - protein, 8 aa, Artificial Sequence
  Peptide Derived from Human Papillomavirus
IIHLKGDK

SEQ ID NO: 37706 - protein, 10 aa, Artificial Sequence
  Peptide Derived from Human Papillomavirus
ILDHYENDSK

SEQ ID NO: 37707 - protein, 8 aa, Artificial Sequence
  Peptide Derived from Human Papillomavirus
ILFTAREH

SEQ ID NO: 37708 - protein, 8 aa, Artificial Sequence
  Peptide Derived from Human Papillomavirus
ISKSKAHK

SEQ ID NO: 37709 - protein, 9 aa, Artificial Sequence
  Peptide Derived from Human Papillomavirus
ISKSKAHKA

SEQ ID NO: 37710 - protein, 8 aa, Artificial Sequence
  Peptide Derived from Human Papillomavirus
ISYWQLIR

SEQ ID NO: 37711 - protein, 9 aa, Artificial Sequence
  Peptide Derived from Human Papillomavirus
ITETGIWDK

SEQ ID NO: 37712 - protein, 11 aa, Artificial Sequence
  Peptide Derived from Human Papillomavirus
ITETGIWDKTA

SEQ ID NO: 37713 - protein, 8 aa, Artificial Sequence
  Peptide Derived from Human Papillomavirus
IVRQLQHA

SEQ ID NO: 37714 - protein, 11 aa, Artificial Sequence
  Peptide Derived from Human Papillomavirus
KAHKAIELQMA

SEQ ID NO: 37715 - protein, 8 aa, Artificial Sequence
  Peptide Derived from Human Papillomavirus
KAIELQMA

SEQ ID NO: 37716 - protein, 10 aa, Artificial Sequence
  Peptide Derived from Human Papillomavirus
KAIELQMALK

SEQ ID NO: 37717 - protein, 8 aa, Artificial Sequence
  Peptide Derived from Human Papillomavirus
KCLRYRLR

SEQ ID NO: 37718 - protein, 9 aa, Artificial Sequence
  Peptide Derived from Human Papillomavirus
KCLRYRLRK

SEQ ID NO: 37719 - protein, 10 aa, Artificial Sequence
  Peptide Derived from Human Papillomavirus
KCLRYRLRKY

SEQ ID NO: 37720 - protein, 11 aa, Artificial Sequence
  Peptide Derived from Human Papillomavirus
KCLRYRLRKYA

SEQ ID NO: 37721 - protein, 8 aa, Artificial Sequence
  Peptide Derived from Human Papillomavirus
KDGDTTYY

SEQ ID NO: 37722 - protein, 11 aa, Artificial Sequence
  Peptide Derived from Human Papillomavirus
KDGDTTYYVQF

SEQ ID NO: 37723 - protein, 9 aa, Artificial Sequence
  Peptide Derived from Human Papillomavirus
KDINSQISY

SEQ ID NO: 37724 - protein, 8 aa, Artificial Sequence
  Peptide Derived from Human Papillomavirus
KGDKNSLK

SEQ ID NO: 37725 - protein, 11 aa, Artificial Sequence
  Peptide Derived from Human Papillomavirus
KGDKNSLKCLR

SEQ ID NO: 37726 - protein, 9 aa, Artificial Sequence
  Peptide Derived from Human Papillomavirus
KGGKTVHVY

SEQ ID NO: 37727 - protein, 10 aa, Artificial Sequence
  Peptide Derived from Human Papillomavirus
KGGKTVHVYF

SEQ ID NO: 37728 - protein, 8 aa, Artificial Sequence
  Peptide Derived from Human Papillomavirus
KGLAQSKY

SEQ ID NO: 37729 - protein, 11 aa, Artificial Sequence
  Peptide Derived from Human Papillomavirus
KILDHYENDSK

SEQ ID NO: 37730 - protein, 8 aa, Artificial Sequence
  Peptide Derived from Human Papillomavirus
KTAACVSY

SEQ ID NO: 37731 - protein, 9 aa, Artificial Sequence
  Peptide Derived from Human Papillomavirus
KTASVGTPK

SEQ ID NO: 37732 - protein, 11 aa, Artificial Sequence
  Peptide Derived from Human Papillomavirus
KTASVGTPKPH

SEQ ID NO: 37733 - protein, 11 aa, Artificial Sequence
  Peptide Derived from Human Papillomavirus
KTVHVYFDGNK

SEQ ID NO: 37734 - protein, 9 aa, Artificial Sequence
  Peptide Derived from Human Papillomavirus
LCSSTSNNK

SEQ ID NO: 37735 - protein, 10 aa, Artificial Sequence
  Peptide Derived from Human Papillomavirus
LCSSTSNNKR

SEQ ID NO: 37736 - protein, 11 aa, Artificial Sequence
  Peptide Derived from Human Papillomavirus
LCSSTSNNKRR

SEQ ID NO: 37737 - protein, 9 aa, Artificial Sequence
  Peptide Derived from Human Papillomavirus
LDHYENDSK

SEQ ID NO: 37738 - protein, 11 aa, Artificial Sequence
  Peptide Derived from Human Papillomavirus
LFTAREHGITK

SEQ ID NO: 37739 - protein, 10 aa, Artificial Sequence
  Peptide Derived from Human Papillomavirus
LIRLENAILF

SEQ ID NO: 37740 - protein, 10 aa, Artificial Sequence
  Peptide Derived from Human Papillomavirus
LLCSSTSNNK

SEQ ID NO: 37741 - protein, 11 aa, Artificial Sequence
  Peptide Derived from Human Papillomavirus
LLCSSTSNNKR

SEQ ID NO: 37742 - protein, 11 aa, Artificial Sequence
  Peptide Derived from Human Papillomavirus
LSALQDKILDH

SEQ ID NO: 37743 - protein, 11 aa, Artificial Sequence
  Peptide Derived from Human Papillomavirus
LSERLSALQDK

SEQ ID NO: 37744 - protein, 8 aa, Artificial Sequence
  Peptide Derived from Human Papillomavirus
LTEQHHGR

SEQ ID NO: 37745 - protein, 11 aa, Artificial Sequence
  Peptide Derived from Human Papillomavirus
LTVTYNSEVQR

SEQ ID NO: 37746 - protein, 10 aa, Artificial Sequence
  Peptide Derived from Human Papillomavirus
MALKGLAQSK

SEQ ID NO: 37747 - protein, 11 aa, Artificial Sequence
  Peptide Derived from Human Papillomavirus
MALKGLAQSKY

SEQ ID NO: 37748 - protein, 11 aa, Artificial Sequence
  Peptide Derived from Human Papillomavirus
MCSTSDDTVSA

SEQ ID NO: 37749 - protein, 8 aa, Artificial Sequence
  Peptide Derived from Human Papillomavirus
NAILFTAR

SEQ ID NO: 37750 - protein, 10 aa, Artificial Sequence
  Peptide Derived from Human Papillomavirus
NAILFTAREH

SEQ ID NO: 37751 - protein, 8 aa, Artificial Sequence
  Peptide Derived from Human Papillomavirus
NISKSKAH

SEQ ID NO: 37752 - protein, 9 aa, Artificial Sequence
  Peptide Derived from Human Papillomavirus
NISKSKAHK

SEQ ID NO: 37753 - protein, 10 aa, Artificial Sequence
  Peptide Derived from Human Papillomavirus
NISKSKAHKA

SEQ ID NO: 37754 - protein, 9 aa, Artificial Sequence
  Peptide Derived from Human Papillomavirus
NSEVQRNTF

SEQ ID NO: 37755 - protein, 8 aa, Artificial Sequence
  Peptide Derived from Human Papillomavirus
NSLKCLRY

SEQ ID NO: 37756 - protein, 9 aa, Artificial Sequence
  Peptide Derived from Human Papillomavirus
NSLKCLRYR

SEQ ID NO: 37757 - protein, 11 aa, Artificial Sequence
  Peptide Derived from Human Papillomavirus
NSLKCLRYRLR

SEQ ID NO: 37758 - protein, 9 aa, Artificial Sequence
  Peptide Derived from Human Papillomavirus
NSNTWEVQY

SEQ ID NO: 37759 - protein, 11 aa, Artificial Sequence
  Peptide Derived from Human Papillomavirus
NSQISYWQLIR

SEQ ID NO: 37760 - protein, 9 aa, Artificial Sequence
  Peptide Derived from Human Papillomavirus
NSVQISVGY

SEQ ID NO: 37761 - protein, 8 aa, Artificial Sequence
  Peptide Derived from Human Papillomavirus
NTEPSQCF

SEQ ID NO: 37762 - protein, 9 aa, Artificial Sequence
  Peptide Derived from Human Papillomavirus
NTEPSQCFK

SEQ ID NO: 37763 - protein, 10 aa, Artificial Sequence
  Peptide Derived from Human Papillomavirus
NTEPSQCFKK

SEQ ID NO: 37764 - protein, 9 aa, Artificial Sequence
  Peptide Derived from Human Papillomavirus
NTGILTVTY

SEQ ID NO: 37765 - protein, 9 aa, Artificial Sequence
  Peptide Derived from Human Papillomavirus
NTTPIIHLK

SEQ ID NO: 37766 - protein, 9 aa, Artificial Sequence
  Peptide Derived from Human Papillomavirus
PIIHLKGDK

SEQ ID NO: 37767 - protein, 8 aa, Artificial Sequence
  Peptide Derived from Human Papillomavirus
PINISKSK

SEQ ID NO: 37768 - protein, 9 aa, Artificial Sequence
  Peptide Derived from Human Papillomavirus
PINISKSKA

SEQ ID NO: 37769 - protein, 10 aa, Artificial Sequence
  Peptide Derived from Human Papillomavirus
PINISKSKAH

SEQ ID NO: 37770 - protein, 11 aa, Artificial Sequence
  Peptide Derived from Human Papillomavirus
PINISKSKAHK

SEQ ID NO: 37771 - protein, 11 aa, Artificial Sequence
  Peptide Derived from Human Papillomavirus
PLLCSSTSNNK

SEQ ID NO: 37772 - protein, 10 aa, Artificial Sequence
  Peptide Derived from Human Papillomavirus
PSQCFKKGGK

SEQ ID NO: 37773 - protein, 8 aa, Artificial Sequence
  Peptide Derived from Human Papillomavirus
QCFKKGGK

SEQ ID NO: 37774 - protein, 11 aa, Artificial Sequence
  Peptide Derived from Human Papillomavirus
QCFKKGGKTVH

SEQ ID NO: 37775 - protein, 8 aa, Artificial Sequence
  Peptide Derived from Human Papillomavirus
QCGLTEQH

SEQ ID NO: 37776 - protein, 9 aa, Artificial Sequence
  Peptide Derived from Human Papillomavirus
QCGLTEQHH

SEQ ID NO: 37777 - protein, 11 aa, Artificial Sequence
  Peptide Derived from Human Papillomavirus
QCGLTEQHHGR

SEQ ID NO: 37778 - protein, 8 aa, Artificial Sequence
  Peptide Derived from Human Papillomavirus
QDKILDHY

SEQ ID NO: 37779 - protein, 8 aa, Artificial Sequence
  Peptide Derived from Human Papillomavirus
QFKSECEK

SEQ ID NO: 37780 - protein, 9 aa, Artificial Sequence
  Peptide Derived from Human Papillomavirus
QFKSECEKY

SEQ ID NO: 37781 - protein, 9 aa, Artificial Sequence
  Peptide Derived from Human Papillomavirus
QISYWQLIR

SEQ ID NO: 37782 - protein, 8 aa, Artificial Sequence
  Peptide Derived from Human Papillomavirus
QIVRQLQH

SEQ ID NO: 37783 - protein, 9 aa, Artificial Sequence
  Peptide Derived from Human Papillomavirus
QIVRQLQHA

SEQ ID NO: 37784 - protein, 8 aa, Artificial Sequence
  Peptide Derived from Human Papillomavirus
QLIRLENA

SEQ ID NO: 37785 - protein, 11 aa, Artificial Sequence
  Peptide Derived from Human Papillomavirus
QLIRLENAILF

SEQ ID NO: 37786 - protein, 11 aa, Artificial Sequence
  Peptide Derived from Human Papillomavirus
QLQHASTSTPK

SEQ ID NO: 37787 - protein, 8 aa, Artificial Sequence
  Peptide Derived from Human Papillomavirus
QMALKGLA

SEQ ID NO: 37788 - protein, 11 aa, Artificial Sequence
  Peptide Derived from Human Papillomavirus
QMALKGLAQSK

SEQ ID NO: 37789 - protein, 9 aa, Artificial Sequence
  Peptide Derived from Human Papillomavirus
QTPATKRPR

SEQ ID NO: 37790 - protein, 10 aa, Artificial Sequence
  Peptide Derived from Human Papillomavirus
QTPKESLSER

SEQ ID NO: 37791 - protein, 10 aa, Artificial Sequence
  Peptide Derived from Human Papillomavirus
QVVPPINISK

SEQ ID NO: 37792 - protein, 8 aa, Artificial Sequence
  Peptide Derived from Human Papillomavirus
RLENAILF

SEQ ID NO: 37793 - protein, 10 aa, Artificial Sequence
  Peptide Derived from Human Papillomavirus
RLENAILFTA

SEQ ID NO: 37794 - protein, 11 aa, Artificial Sequence
  Peptide Derived from Human Papillomavirus
RLENAILFTAR

SEQ ID NO: 37795 - protein, 8 aa, Artificial Sequence
  Peptide Derived from Human Papillomavirus
RLRKYADH

SEQ ID NO: 37796 - protein, 9 aa, Artificial Sequence
  Peptide Derived from Human Papillomavirus
RLRKYADHY

SEQ ID NO: 37797 - protein, 8 aa, Artificial Sequence
  Peptide Derived from Human Papillomavirus
RLSALQDK

SEQ ID NO: 37798 - protein, 10 aa, Artificial Sequence
  Peptide Derived from Human Papillomavirus
SALQDKILDH

SEQ ID NO: 37799 - protein, 11 aa, Artificial Sequence
  Peptide Derived from Human Papillomavirus
SALQDKILDHY

SEQ ID NO: 37800 - protein, 11 aa, Artificial Sequence
  Peptide Derived from Human Papillomavirus
SATQIVRQLQH

SEQ ID NO: 37801 - protein, 9 aa, Artificial Sequence
  Peptide Derived from Human Papillomavirus
SGNTTPIIH

SEQ ID NO: 37802 - protein, 11 aa, Artificial Sequence
  Peptide Derived from Human Papillomavirus
SGNTTPIIHLK

SEQ ID NO: 37803 - protein, 8 aa, Artificial Sequence
  Peptide Derived from Human Papillomavirus
SLKCLRYR

SEQ ID NO: 37804 - protein, 10 aa, Artificial Sequence
  Peptide Derived from Human Papillomavirus
SLKCLRYRLR

SEQ ID NO: 37805 - protein, 11 aa, Artificial Sequence
  Peptide Derived from Human Papillomavirus
SLKCLRYRLRK

SEQ ID NO: 37806 - protein, 8 aa, Artificial Sequence
  Peptide Derived from Human Papillomavirus
SLSERLSA

SEQ ID NO: 37807 - protein, 8 aa, Artificial Sequence
  Peptide Derived from Human Papillomavirus
SSTSNNKR

SEQ ID NO: 37808 - protein, 9 aa, Artificial Sequence
  Peptide Derived from Human Papillomavirus
SSTSNNKRR

SEQ ID NO: 37809 - protein, 10 aa, Artificial Sequence
  Peptide Derived from Human Papillomavirus
SSTSNNKRRK

SEQ ID NO: 37810 - protein, 11 aa, Artificial Sequence
  Peptide Derived from Human Papillomavirus
SSTWHWTGCNK

SEQ ID NO: 37811 - protein, 9 aa, Artificial Sequence
  Peptide Derived from Human Papillomavirus
STSDDTVSA

SEQ ID NO: 37812 - protein, 8 aa, Artificial Sequence
  Peptide Derived from Human Papillomavirus
STSNNKRR

SEQ ID NO: 37813 - protein, 9 aa, Artificial Sequence
  Peptide Derived from Human Papillomavirus
STSNNKRRK

SEQ ID NO: 37814 - protein, 8 aa, Artificial Sequence
  Peptide Derived from Human Papillomavirus
STSTPKTA

SEQ ID NO: 37815 - protein, 10 aa, Artificial Sequence
  Peptide Derived from Human Papillomavirus
STWHWTGCNK

SEQ ID NO: 37816 - protein, 8 aa, Artificial Sequence
  Peptide Derived from Human Papillomavirus
SVGTPKPH

SEQ ID NO: 37817 - protein, 8 aa, Artificial Sequence
  Peptide Derived from Human Papillomavirus
SVQISVGY

SEQ ID NO: 37818 - protein, 11 aa, Artificial Sequence
  Peptide Derived from Human Papillomavirus
TAACVSYWGVY

SEQ ID NO: 37819 - protein, 9 aa, Artificial Sequence
  Peptide Derived from Human Papillomavirus
TAREHGITK

SEQ ID NO: 37820 - protein, 8 aa, Artificial Sequence
  Peptide Derived from Human Papillomavirus
TASVGTPK

SEQ ID NO: 37821 - protein, 10 aa, Artificial Sequence
  Peptide Derived from Human Papillomavirus
TASVGTPKPH

SEQ ID NO: 37822 - protein, 8 aa, Artificial Sequence
  Peptide Derived from Human Papillomavirus
TGILTVTY

SEQ ID NO: 37823 - protein, 8 aa, Artificial Sequence
  Peptide Derived from Human Papillomavirus
TGIWDKTA

SEQ ID NO: 37824 - protein, 9 aa, Artificial Sequence
  Peptide Derived from Human Papillomavirus
TGIWDKTAA

SEQ ID NO: 37825 - protein, 8 aa, Artificial Sequence
  Peptide Derived from Human Papillomavirus
TSDDTVSA

SEQ ID NO: 37826 - protein, 8 aa, Artificial Sequence
  Peptide Derived from Human Papillomavirus
TSNNKRRK

SEQ ID NO: 37827 - protein, 8 aa, Artificial Sequence
  Peptide Derived from Human Papillomavirus
TTPIIHLK

SEQ ID NO: 37828 - protein, 11 aa, Artificial Sequence
  Peptide Derived from Human Papillomavirus
TTPIIHLKGDK

SEQ ID NO: 37829 - protein, 8 aa, Artificial Sequence
  Peptide Derived from Human Papillomavirus
TTYYVQFK

SEQ ID NO: 37830 - protein, 10 aa, Artificial Sequence
  Peptide Derived from Human Papillomavirus
TVHVYFDGNK

SEQ ID NO: 37831 - protein, 9 aa, Artificial Sequence
  Peptide Derived from Human Papillomavirus
TVSATQIVR

SEQ ID NO: 37832 - protein, 10 aa, Artificial Sequence
  Peptide Derived from Human Papillomavirus
TVTYNSEVQR

SEQ ID NO: 37833 - protein, 11 aa, Artificial Sequence
  Peptide Derived from Human Papillomavirus
VCSGNTTPIIH

SEQ ID NO: 37834 - protein, 8 aa, Artificial Sequence
  Peptide Derived from Human Papillomavirus
VSATQIVR

SEQ ID NO: 37835 - protein, 8 aa, Artificial Sequence
  Peptide Derived from Human Papillomavirus
VSYWGVYY

SEQ ID NO: 37836 - protein, 10 aa, Artificial Sequence
  Peptide Derived from Human Papillomavirus
VSYWGVYYIK

SEQ ID NO: 37837 - protein, 9 aa, Artificial Sequence
  Peptide Derived from Human Papillomavirus
VTYNSEVQR

SEQ ID NO: 37838 - protein, 9 aa, Artificial Sequence
  Peptide Derived from Human Papillomavirus
VVPPINISK

SEQ ID NO: 37839 - protein, 11 aa, Artificial Sequence
  Peptide Derived from Human Papillomavirus
VVPPINISKSK

SEQ ID NO: 37840 - protein, 8 aa, Artificial Sequence
  Peptide Derived from Human Papillomavirus
VVWDSIYY

SEQ ID NO: 37841 - protein, 10 aa, Artificial Sequence
  Peptide Derived from Human Papillomavirus
WDKTAACVSY

SEQ ID NO: 37842 - protein, 11 aa, Artificial Sequence
  Peptide Derived from Human Papillomavirus
YGNSNTWEVQY

SEQ ID NO: 37843 - protein, 9 aa, Artificial Sequence
  Peptide Derived from Human Papillomavirus
YIKDGDTTY

SEQ ID NO: 37844 - protein, 10 aa, Artificial Sequence
  Peptide Derived from Human Papillomavirus
YIKDGDTTYY

SEQ ID NO: 37845 - protein, 10 aa, Artificial Sequence
  Peptide Derived from Human Papillomavirus
YITETGIWDK

SEQ ID NO: 37846 - protein, 9 aa, Artificial Sequence
  Peptide Derived from Human Papillomavirus
YSEISSTWH

SEQ ID NO: 37847 - protein, 10 aa, Artificial Sequence
  Peptide Derived from Human Papillomavirus
YVQFKSECEK

SEQ ID NO: 37848 - protein, 11 aa, Artificial Sequence
  Peptide Derived from Human Papillomavirus
YVQFKSECEKY

SEQ ID NO: 37849 - protein, 8 aa, Artificial Sequence
  Peptide Derived from Human Papillomavirus
YVVWDSIY

SEQ ID NO: 37850 - protein, 9 aa, Artificial Sequence
  Peptide Derived from Human Papillomavirus
YVVWDSIYY

SEQ ID NO: 37851 - protein, 9 aa, Artificial Sequence
  Peptide Derived from Human Papillomavirus
AACHKCIDF

SEQ ID NO: 37852 - protein, 10 aa, Artificial Sequence
  Peptide Derived from Human Papillomavirus
AACHKCIDFY

SEQ ID NO: 37853 - protein, 8 aa, Artificial Sequence
  Peptide Derived from Human Papillomavirus
ACHKCIDF

SEQ ID NO: 37854 - protein, 9 aa, Artificial Sequence
  Peptide Derived from Human Papillomavirus
ACHKCIDFY

SEQ ID NO: 37855 - protein, 11 aa, Artificial Sequence
  Peptide Derived from Human Papillomavirus
ACHKCIDFYSR

SEQ ID NO: 37856 - protein, 11 aa, Artificial Sequence
  Peptide Derived from Human Papillomavirus
ACVYCKATLER

SEQ ID NO: 37857 - protein, 9 aa, Artificial Sequence
  Peptide Derived from Human Papillomavirus
AFKDLFIVY

SEQ ID NO: 37858 - protein, 10 aa, Artificial Sequence
  Peptide Derived from Human Papillomavirus
AFKDLFIVYR

SEQ ID NO: 37859 - protein, 9 aa, Artificial Sequence
  Peptide Derived from Human Papillomavirus
ATLERTEVY

SEQ ID NO: 37860 - protein, 11 aa, Artificial Sequence
  Peptide Derived from Human Papillomavirus
ATLERTEVYQF

SEQ ID NO: 37861 - protein, 9 aa, Artificial Sequence
  Peptide Derived from Human Papillomavirus
CCDQARQER

SEQ ID NO: 37862 - protein, 11 aa, Artificial Sequence
  Peptide Derived from Human Papillomavirus
CCDQARQERLR

SEQ ID NO: 37863 - protein, 8 aa, Artificial Sequence
  Peptide Derived from Human Papillomavirus
CDQARQER

SEQ ID NO: 37864 - protein, 10 aa, Artificial Sequence
  Peptide Derived from Human Papillomavirus
CDQARQERLR

SEQ ID NO: 37865 - protein, 11 aa, Artificial Sequence
  Peptide Derived from Human Papillomavirus
CDQARQERLRR

SEQ ID NO: 37866 - protein, 8 aa, Artificial Sequence
  Peptide Derived from Human Papillomavirus
CIAYAACH

SEQ ID NO: 37867 - protein, 9 aa, Artificial Sequence
  Peptide Derived from Human Papillomavirus
CIAYAACHK

SEQ ID NO: 37868 - protein, 9 aa, Artificial Sequence
  Peptide Derived from Human Papillomavirus
CIDFYSRIR

SEQ ID NO: 37869 - protein, 11 aa, Artificial Sequence
  Peptide Derived from Human Papillomavirus
CLRCQKPLNPA

SEQ ID NO: 37870 - protein, 10 aa, Artificial Sequence
  Peptide Derived from Human Papillomavirus
CVYCKATLER

SEQ ID NO: 37871 - protein, 9 aa, Artificial Sequence
  Peptide Derived from Human Papillomavirus
DCIAYAACH

SEQ ID NO: 37872 - protein, 10 aa, Artificial Sequence
  Peptide Derived from Human Papillomavirus
DCIAYAACHK

SEQ ID NO: 37873 - protein, 8 aa, Artificial Sequence
  Peptide Derived from Human Papillomavirus
DDPTQRPY

SEQ ID NO: 37874 - protein, 9 aa, Artificial Sequence
  Peptide Derived from Human Papillomavirus
DDPTQRPYK

SEQ ID NO: 37875 - protein, 10 aa, Artificial Sequence
  Peptide Derived from Human Papillomavirus
DFYSRIRELR

SEQ ID NO: 37876 - protein, 11 aa, Artificial Sequence
  Peptide Derived from Human Papillomavirus
DFYSRIRELRY

SEQ ID NO: 37877 - protein, 11 aa, Artificial Sequence
  Peptide Derived from Human Papillomavirus
DLFIVYRDCIA

SEQ ID NO: 37878 - protein, 8 aa, Artificial Sequence
  Peptide Derived from Human Papillomavirus
DVSIACVY

SEQ ID NO: 37879 - protein, 10 aa, Artificial Sequence
  Peptide Derived from Human Papillomavirus
DVSIACVYCK

SEQ ID NO: 37880 - protein, 11 aa, Artificial Sequence
  Peptide Derived from Human Papillomavirus
DVSIACVYCKA

SEQ ID NO: 37881 - protein, 10 aa, Artificial Sequence
  Peptide Derived from Human Papillomavirus
ELRYYSNSVY

SEQ ID NO: 37882 - protein, 8 aa, Artificial Sequence
  Peptide Derived from Human Papillomavirus
ELYNLLIR

SEQ ID NO: 37883 - protein, 11 aa, Artificial Sequence
  Peptide Derived from Human Papillomavirus
ELYNLLIRCLR

SEQ ID NO: 37884 - protein, 8 aa, Artificial Sequence
  Peptide Derived from Human Papillomavirus
EVYQFAFK

SEQ ID NO: 37885 - protein, 11 aa, Artificial Sequence
  Peptide Derived from Human Papillomavirus
EVYQFAFKDLF

SEQ ID NO: 37886 - protein, 10 aa, Artificial Sequence
  Peptide Derived from Human Papillomavirus
FAFKDLFIVY

SEQ ID NO: 37887 - protein, 11 aa, Artificial Sequence
  Peptide Derived from Human Papillomavirus
FAFKDLFIVYR

SEQ ID NO: 37888 - protein, 9 aa, Artificial Sequence
  Peptide Derived from Human Papillomavirus
FDDPTQRPY

SEQ ID NO: 37889 - protein, 10 aa, Artificial Sequence
  Peptide Derived from Human Papillomavirus
FDDPTQRPYK

SEQ ID NO: 37890 - protein, 9 aa, Artificial Sequence
  Peptide Derived from Human Papillomavirus
FIVYRDCIA

SEQ ID NO: 37891 - protein, 10 aa, Artificial Sequence
  Peptide Derived from Human Papillomavirus
FIVYRDCIAY

SEQ ID NO: 37892 - protein, 11 aa, Artificial Sequence
  Peptide Derived from Human Papillomavirus
FIVYRDCIAYA

SEQ ID NO: 37893 - protein, 8 aa, Artificial Sequence
  Peptide Derived from Human Papillomavirus
HLKDKRRF

SEQ ID NO: 37894 - protein, 9 aa, Artificial Sequence
  Peptide Derived from Human Papillomavirus
HLKDKRRFH

SEQ ID NO: 37895 - protein, 8 aa, Artificial Sequence
  Peptide Derived from Human Papillomavirus
HSIAGQYR

SEQ ID NO: 37896 - protein, 8 aa, Artificial Sequence
  Peptide Derived from Human Papillomavirus
IACVYCKA

SEQ ID NO: 37897 - protein, 8 aa, Artificial Sequence
  Peptide Derived from Human Papillomavirus
IAYAACHK

SEQ ID NO: 37898 - protein, 8 aa, Artificial Sequence
  Peptide Derived from Human Papillomavirus
IDFYSRIR

SEQ ID NO: 37899 - protein, 11 aa, Artificial Sequence
  Peptide Derived from Human Papillomavirus
IDFYSRIRELR

SEQ ID NO: 37900 - protein, 8 aa, Artificial Sequence
  Peptide Derived from Human Papillomavirus
IVYRDCIA

SEQ ID NO: 37901 - protein, 9 aa, Artificial Sequence
  Peptide Derived from Human Papillomavirus
IVYRDCIAY

SEQ ID NO: 37902 - protein, 10 aa, Artificial Sequence
  Peptide Derived from Human Papillomavirus
IVYRDCIAYA

SEQ ID NO: 37903 - protein, 11 aa, Artificial Sequence
  Peptide Derived from Human Papillomavirus
IVYRDCIAYAA

SEQ ID NO: 37904 - protein, 10 aa, Artificial Sequence
  Peptide Derived from Human Papillomavirus
KATLERTEVY

SEQ ID NO: 37905 - protein, 8 aa, Artificial Sequence
  Peptide Derived from Human Papillomavirus
KCIDFYSR

SEQ ID NO: 37906 - protein, 10 aa, Artificial Sequence
  Peptide Derived from Human Papillomavirus
KCIDFYSRIR

SEQ ID NO: 37907 - protein, 10 aa, Artificial Sequence
  Peptide Derived from Human Papillomavirus
KDKRRFHSIA

SEQ ID NO: 37908 - protein, 8 aa, Artificial Sequence
  Peptide Derived from Human Papillomavirus
KDLFIVYR

SEQ ID NO: 37909 - protein, 8 aa, Artificial Sequence
  Peptide Derived from Human Papillomavirus
KITNTELY

SEQ ID NO: 37910 - protein, 10 aa, Artificial Sequence
  Peptide Derived from Human Papillomavirus
LFIVYRDCIA

SEQ ID NO: 37911 - protein, 11 aa, Artificial Sequence
  Peptide Derived from Human Papillomavirus
LFIVYRDCIAY

SEQ ID NO: 37912 - protein, 9 aa, Artificial Sequence
  Peptide Derived from Human Papillomavirus
LIRCLRCQK

SEQ ID NO: 37913 - protein, 10 aa, Artificial Sequence
  Peptide Derived from Human Papillomavirus
LLIRCLRCQK

SEQ ID NO: 37914 - protein, 10 aa, Artificial Sequence
  Peptide Derived from Human Papillomavirus
MARFDDPTQR

SEQ ID NO: 37915 - protein, 8 aa, Artificial Sequence
  Peptide Derived from Human Papillomavirus
NLLIRCLR

SEQ ID NO: 37916 - protein, 11 aa, Artificial Sequence
  Peptide Derived from Human Papillomavirus
NLLIRCLRCQK

SEQ ID NO: 37917 - protein, 10 aa, Artificial Sequence
  Peptide Derived from Human Papillomavirus
NSVYGETLEK

SEQ ID NO: 37918 - protein, 8 aa, Artificial Sequence
  Peptide Derived from Human Papillomavirus
NTCCDQAR

SEQ ID NO: 37919 - protein, 11 aa, Artificial Sequence
  Peptide Derived from Human Papillomavirus
NTCCDQARQER

SEQ ID NO: 37920 - protein, 10 aa, Artificial Sequence
  Peptide Derived from Human Papillomavirus
NTELYNLLIR

SEQ ID NO: 37921 - protein, 10 aa, Artificial Sequence
  Peptide Derived from Human Papillomavirus
NTSLQDVSIA

SEQ ID NO: 37922 - protein, 9 aa, Artificial Sequence
  Peptide Derived from Human Papillomavirus
PAEKRRHLK

SEQ ID NO: 37923 - protein, 11 aa, Artificial Sequence
  Peptide Derived from Human Papillomavirus
PAEKRRHLKDK

SEQ ID NO: 37924 - protein, 8 aa, Artificial Sequence
  Peptide Derived from Human Papillomavirus
PLNPAEKR

SEQ ID NO: 37925 - protein, 9 aa, Artificial Sequence
  Peptide Derived from Human Papillomavirus
PLNPAEKRR

SEQ ID NO: 37926 - protein, 10 aa, Artificial Sequence
  Peptide Derived from Human Papillomavirus
PLNPAEKRRH

SEQ ID NO: 37927 - protein, 8 aa, Artificial Sequence
  Peptide Derived from Human Papillomavirus
QARQERLR

SEQ ID NO: 37928 - protein, 9 aa, Artificial Sequence
  Peptide Derived from Human Papillomavirus
QARQERLRR

SEQ ID NO: 37929 - protein, 10 aa, Artificial Sequence
  Peptide Derived from Human Papillomavirus
QARQERLRRR

SEQ ID NO: 37930 - protein, 11 aa, Artificial Sequence
  Peptide Derived from Human Papillomavirus
QARQERLRRRR

SEQ ID NO: 37931 - protein, 9 aa, Artificial Sequence
  Peptide Derived from Human Papillomavirus
QCNTCCDQA

SEQ ID NO: 37932 - protein, 10 aa, Artificial Sequence
  Peptide Derived from Human Papillomavirus
QCNTCCDQAR

SEQ ID NO: 37933 - protein, 9 aa, Artificial Sequence
  Peptide Derived from Human Papillomavirus
QDVSIACVY

SEQ ID NO: 37934 - protein, 11 aa, Artificial Sequence
  Peptide Derived from Human Papillomavirus
QDVSIACVYCK

SEQ ID NO: 37935 - protein, 8 aa, Artificial Sequence
  Peptide Derived from Human Papillomavirus
QFAFKDLF

SEQ ID NO: 37936 - protein, 11 aa, Artificial Sequence
  Peptide Derived from Human Papillomavirus
QFAFKDLFIVY

SEQ ID NO: 37937 - protein, 9 aa, Artificial Sequence
  Peptide Derived from Human Papillomavirus
RCQKPLNPA

SEQ ID NO: 37938 - protein, 11 aa, Artificial Sequence
  Peptide Derived from Human Papillomavirus
RCQKPLNPAEK

SEQ ID NO: 37939 - protein, 8 aa, Artificial Sequence
  Peptide Derived from Human Papillomavirus
RDCIAYAA

SEQ ID NO: 37940 - protein, 10 aa, Artificial Sequence
  Peptide Derived from Human Papillomavirus
RDCIAYAACH

SEQ ID NO: 37941 - protein, 11 aa, Artificial Sequence
  Peptide Derived from Human Papillomavirus
RDCIAYAACHK

SEQ ID NO: 37942 - protein, 8 aa, Artificial Sequence
  Peptide Derived from Human Papillomavirus
RFDDPTQR

SEQ ID NO: 37943 - protein, 10 aa, Artificial Sequence
  Peptide Derived from Human Papillomavirus
RFDDPTQRPY

SEQ ID NO: 37944 - protein, 11 aa, Artificial Sequence
  Peptide Derived from Human Papillomavirus
RFDDPTQRPYK

SEQ ID NO: 37945 - protein, 9 aa, Artificial Sequence
  Peptide Derived from Human Papillomavirus
RFHSIAGQY

SEQ ID NO: 37946 - protein, 10 aa, Artificial Sequence
  Peptide Derived from Human Papillomavirus
RFHSIAGQYR

SEQ ID NO: 37947 - protein, 11 aa, Artificial Sequence
  Peptide Derived from Human Papillomavirus
RGQCNTCCDQA

SEQ ID NO: 37948 - protein, 8 aa, Artificial Sequence
  Peptide Derived from Human Papillomavirus
RIRELRYY

SEQ ID NO: 37949 - protein, 8 aa, Artificial Sequence
  Peptide Derived from Human Papillomavirus
RTEVYQFA

SEQ ID NO: 37950 - protein, 9 aa, Artificial Sequence
  Peptide Derived from Human Papillomavirus
RTEVYQFAF

SEQ ID NO: 37951 - protein, 10 aa, Artificial Sequence
  Peptide Derived from Human Papillomavirus
RTEVYQFAFK

SEQ ID NO: 37952 - protein, 8 aa, Artificial Sequence
  Peptide Derived from Human Papillomavirus
SIACVYCK

SEQ ID NO: 37953 - protein, 9 aa, Artificial Sequence
  Peptide Derived from Human Papillomavirus
SIACVYCKA

SEQ ID NO: 37954 - protein, 8 aa, Artificial Sequence
  Peptide Derived from Human Papillomavirus
SLQDVSIA

SEQ ID NO: 37955 - protein, 11 aa, Artificial Sequence
  Peptide Derived from Human Papillomavirus
SLQDVSIACVY

SEQ ID NO: 37956 - protein, 9 aa, Artificial Sequence
  Peptide Derived from Human Papillomavirus
SVYGETLEK

SEQ ID NO: 37957 - protein, 10 aa, Artificial Sequence
  Peptide Derived from Human Papillomavirus
TCCDQARQER

SEQ ID NO: 37958 - protein, 11 aa, Artificial Sequence
  Peptide Derived from Human Papillomavirus
TLEKITNTELY

SEQ ID NO: 37959 - protein, 8 aa, Artificial Sequence
  Peptide Derived from Human Papillomavirus
TLERTEVY

SEQ ID NO: 37960 - protein, 10 aa, Artificial Sequence
  Peptide Derived from Human Papillomavirus
TLERTEVYQF

SEQ ID NO: 37961 - protein, 11 aa, Artificial Sequence
  Peptide Derived from Human Papillomavirus
TLERTEVYQFA

SEQ ID NO: 37962 - protein, 9 aa, Artificial Sequence
  Peptide Derived from Human Papillomavirus
TSLQDVSIA

SEQ ID NO: 37963 - protein, 9 aa, Artificial Sequence
  Peptide Derived from Human Papillomavirus
VSIACVYCK

SEQ ID NO: 37964 - protein, 10 aa, Artificial Sequence
  Peptide Derived from Human Papillomavirus
VSIACVYCKA

SEQ ID NO: 37965 - protein, 10 aa, Artificial Sequence
  Peptide Derived from Human Papillomavirus
YAACHKCIDF

SEQ ID NO: 37966 - protein, 11 aa, Artificial Sequence
  Peptide Derived from Human Papillomavirus
YAACHKCIDFY

SEQ ID NO: 37967 - protein, 8 aa, Artificial Sequence
  Peptide Derived from Human Papillomavirus
YCKATLER

SEQ ID NO: 37968 - protein, 8 aa, Artificial Sequence
  Peptide Derived from Human Papillomavirus
YSRIRELR

SEQ ID NO: 37969 - protein, 9 aa, Artificial Sequence
  Peptide Derived from Human Papillomavirus
YSRIRELRY

SEQ ID NO: 37970 - protein, 10 aa, Artificial Sequence
  Peptide Derived from Human Papillomavirus
YSRIRELRYY

SEQ ID NO: 37971 - protein, 11 aa, Artificial Sequence
  Peptide Derived from Human Papillomavirus
ADDLRTLQQLF

SEQ ID NO: 37972 - protein, 11 aa, Artificial Sequence
  Peptide Derived from Human Papillomavirus
ADGVSHAQLPA

SEQ ID NO: 37973 - protein, 9 aa, Artificial Sequence
  Peptide Derived from Human Papillomavirus
ATLQEIVLH

SEQ ID NO: 37974 - protein, 9 aa, Artificial Sequence
  Peptide Derived from Human Papillomavirus
CVCCKCDGR

SEQ ID NO: 37975 - protein, 10 aa, Artificial Sequence
  Peptide Derived from Human Papillomavirus
DDLRTLQQLF

SEQ ID NO: 37976 - protein, 10 aa, Artificial Sequence
  Peptide Derived from Human Papillomavirus
DGVSHAQLPA

SEQ ID NO: 37977 - protein, 11 aa, Artificial Sequence
  Peptide Derived from Human Papillomavirus
DGVSHAQLPAR

SEQ ID NO: 37978 - protein, 9 aa, Artificial Sequence
  Peptide Derived from Human Papillomavirus
DLRTLQQLF

SEQ ID NO: 37979 - protein, 8 aa, Artificial Sequence
  Peptide Derived from Human Papillomavirus
EADGVSHA

SEQ ID NO: 37980 - protein, 10 aa, Artificial Sequence
  Peptide Derived from Human Papillomavirus
ELDPVDLLCY

SEQ ID NO: 37981 - protein, 8 aa, Artificial Sequence
  Peptide Derived from Human Papillomavirus
ELTVESSA

SEQ ID NO: 37982 - protein, 9 aa, Artificial Sequence
  Peptide Derived from Human Papillomavirus
ESEEENDEA

SEQ ID NO: 37983 - protein, 8 aa, Artificial Sequence
  Peptide Derived from Human Papillomavirus
ESSADDLR

SEQ ID NO: 37984 - protein, 9 aa, Artificial Sequence
  Peptide Derived from Human Papillomavirus
GVSHAQLPA

SEQ ID NO: 37985 - protein, 10 aa, Artificial Sequence
  Peptide Derived from Human Papillomavirus
GVSHAQLPAR

SEQ ID NO: 37986 - protein, 11 aa, Artificial Sequence
  Peptide Derived from Human Papillomavirus
GVSHAQLPARR

SEQ ID NO: 37987 - protein, 8 aa, Artificial Sequence
  Peptide Derived from Human Papillomavirus
HAQLPARR

SEQ ID NO: 37988 - protein, 9 aa, Artificial Sequence
  Peptide Derived from Human Papillomavirus
HAQLPARRA

SEQ ID NO: 37989 - protein, 11 aa, Artificial Sequence
  Peptide Derived from Human Papillomavirus
ILCVCCKCDGR

SEQ ID NO: 37990 - protein, 8 aa, Artificial Sequence
  Peptide Derived from Human Papillomavirus
KILCVCCK

SEQ ID NO: 37991 - protein, 10 aa, Artificial Sequence
  Peptide Derived from Human Papillomavirus
LCVCCKCDGR

SEQ ID NO: 37992 - protein, 9 aa, Artificial Sequence
  Peptide Derived from Human Papillomavirus
LDPVDLLCY

SEQ ID NO: 37993 - protein, 8 aa, Artificial Sequence
  Peptide Derived from Human Papillomavirus
LFLSTLSF

SEQ ID NO: 37994 - protein, 11 aa, Artificial Sequence
  Peptide Derived from Human Papillomavirus
LSESEEENDEA

SEQ ID NO: 37995 - protein, 9 aa, Artificial Sequence
  Peptide Derived from Human Papillomavirus
LSFVCPWCA

SEQ ID NO: 37996 - protein, 11 aa, Artificial Sequence
  Peptide Derived from Human Papillomavirus
LTVESSADDLR

SEQ ID NO: 37997 - protein, 9 aa, Artificial Sequence
  Peptide Derived from Human Papillomavirus
NDEADGVSH

SEQ ID NO: 37998 - protein, 10 aa, Artificial Sequence
  Peptide Derived from Human Papillomavirus
NDEADGVSHA

SEQ ID NO: 37999 - protein, 9 aa, Artificial Sequence
  Peptide Derived from Human Papillomavirus
PARRAEPQR

SEQ ID NO: 38000 - protein, 10 aa, Artificial Sequence
  Peptide Derived from Human Papillomavirus
PARRAEPQRH

SEQ ID NO: 38001 - protein, 11 aa, Artificial Sequence
  Peptide Derived from Human Papillomavirus
PARRAEPQRHK

SEQ ID NO: 38002 - protein, 9 aa, Artificial Sequence
  Peptide Derived from Human Papillomavirus
QLFLSTLSF

SEQ ID NO: 38003 - protein, 11 aa, Artificial Sequence
  Peptide Derived from Human Papillomavirus
QLPARRAEPQR

SEQ ID NO: 38004 - protein, 8 aa, Artificial Sequence
  Peptide Derived from Human Papillomavirus
RAEPQRHK

SEQ ID NO: 38005 - protein, 10 aa, Artificial Sequence
  Peptide Derived from Human Papillomavirus
RATLQEIVLH

SEQ ID NO: 38006 - protein, 10 aa, Artificial Sequence
  Peptide Derived from Human Papillomavirus
RIELTVESSA

SEQ ID NO: 38007 - protein, 8 aa, Artificial Sequence
  Peptide Derived from Human Papillomavirus
SFVCPWCA

SEQ ID NO: 38008 - protein, 11 aa, Artificial Sequence
  Peptide Derived from Human Papillomavirus
STLSFVCPWCA

SEQ ID NO: 38009 - protein, 8 aa, Artificial Sequence
  Peptide Derived from Human Papillomavirus
TLQEIVLH

SEQ ID NO: 38010 - protein, 10 aa, Artificial Sequence
  Peptide Derived from Human Papillomavirus
TLSFVCPWCA

SEQ ID NO: 38011 - protein, 10 aa, Artificial Sequence
  Peptide Derived from Human Papillomavirus
TVESSADDLR

SEQ ID NO: 38012 - protein, 8 aa, Artificial Sequence
  Peptide Derived from Human Papillomavirus
VCCKCDGR

SEQ ID NO: 38013 - protein, 8 aa, Artificial Sequence
  Peptide Derived from Human Papillomavirus
VSHAQLPA

SEQ ID NO: 38014 - protein, 9 aa, Artificial Sequence
  Peptide Derived from Human Papillomavirus
VSHAQLPAR

SEQ ID NO: 38015 - protein, 10 aa, Artificial Sequence
  Peptide Derived from Human Papillomavirus
VSHAQLPARR

SEQ ID NO: 38016 - protein, 11 aa, Artificial Sequence
  Peptide Derived from Human Papillomavirus
VSHAQLPARRA

SEQ ID NO: 38017 - protein, 9 aa, Artificial Sequence
  Peptide Derived from Human Papillomavirus
AASTSTASR

SEQ ID NO: 38018 - protein, 11 aa, Artificial Sequence
  Peptide Derived from Human Papillomavirus
AASTSTASRPA

SEQ ID NO: 38019 - protein, 11 aa, Artificial Sequence
  Peptide Derived from Human Papillomavirus
AATAVITQDVR

SEQ ID NO: 38020 - protein, 9 aa, Artificial Sequence
  Peptide Derived from Human Papillomavirus
ACVGMEIGR

SEQ ID NO: 38021 - protein, 9 aa, Artificial Sequence
  Peptide Derived from Human Papillomavirus
ADPYGDSMF

SEQ ID NO: 38022 - protein, 10 aa, Artificial Sequence
  Peptide Derived from Human Papillomavirus
ADPYGDSMFF

SEQ ID NO: 38023 - protein, 9 aa, Artificial Sequence
  Peptide Derived from Human Papillomavirus
AGNKQAVPK

SEQ ID NO: 38024 - protein, 8 aa, Artificial Sequence
  Peptide Derived from Human Papillomavirus
AIGEHWAK

SEQ ID NO: 38025 - protein, 8 aa, Artificial Sequence
  Peptide Derived from Human Papillomavirus
ALPDPNKF

SEQ ID NO: 38026 - protein, 11 aa, Artificial Sequence
  Peptide Derived from Human Papillomavirus
ALWRPSDSTVY

SEQ ID NO: 38027 - protein, 11 aa, Artificial Sequence
  Peptide Derived from Human Papillomavirus
AMDFSTLQDTK

SEQ ID NO: 38028 - protein, 9 aa, Artificial Sequence
  Peptide Derived from Human Papillomavirus
ASRPAKRVR

SEQ ID NO: 38029 - protein, 11 aa, Artificial Sequence
  Peptide Derived from Human Papillomavirus
ASRPAKRVRIR

SEQ ID NO: 38030 - protein, 11 aa, Artificial Sequence
  Peptide Derived from Human Papillomavirus
ASTQNPVPNTY

SEQ ID NO: 38031 - protein, 8 aa, Artificial Sequence
  Peptide Derived from Human Papillomavirus
ASTSTASR

SEQ ID NO: 38032 - protein, 10 aa, Artificial Sequence
  Peptide Derived from Human Papillomavirus
ASTSTASRPA

SEQ ID NO: 38033 - protein, 11 aa, Artificial Sequence
  Peptide Derived from Human Papillomavirus
ASTSTASRPAK

SEQ ID NO: 38034 - protein, 10 aa, Artificial Sequence
  Peptide Derived from Human Papillomavirus
ATAVITQDVR

SEQ ID NO: 38035 - protein, 8 aa, Artificial Sequence
  Peptide Derived from Human Papillomavirus
AVITQDVR

SEQ ID NO: 38036 - protein, 8 aa, Artificial Sequence
  Peptide Derived from Human Papillomavirus
AVPKVSAY

SEQ ID NO: 38037 - protein, 10 aa, Artificial Sequence
  Peptide Derived from Human Papillomavirus
AVPKVSAYQY

SEQ ID NO: 38038 - protein, 11 aa, Artificial Sequence
  Peptide Derived from Human Papillomavirus
AVPKVSAYQYR

SEQ ID NO: 38039 - protein, 8 aa, Artificial Sequence
  Peptide Derived from Human Papillomavirus
CILGCVPA

SEQ ID NO: 38040 - protein, 8 aa, Artificial Sequence
  Peptide Derived from Human Papillomavirus
CLRREQLF

SEQ ID NO: 38041 - protein, 9 aa, Artificial Sequence
  Peptide Derived from Human Papillomavirus
CLRREQLFA

SEQ ID NO: 38042 - protein, 10 aa, Artificial Sequence
  Peptide Derived from Human Papillomavirus
CLRREQLFAR

SEQ ID NO: 38043 - protein, 11 aa, Artificial Sequence
  Peptide Derived from Human Papillomavirus
CLRREQLFARH

SEQ ID NO: 38044 - protein, 8 aa, Artificial Sequence
  Peptide Derived from Human Papillomavirus
CVGMEIGR

SEQ ID NO: 38045 - protein, 8 aa, Artificial Sequence
  Peptide Derived from Human Papillomavirus
CVPAIGEH

SEQ ID NO: 38046 - protein, 10 aa, Artificial Sequence
  Peptide Derived from Human Papillomavirus
CVPAIGEHWA

SEQ ID NO: 38047 - protein, 11 aa, Artificial Sequence
  Peptide Derived from Human Papillomavirus
CVPAIGEHWAK

SEQ ID NO: 38048 - protein, 8 aa, Artificial Sequence
  Peptide Derived from Human Papillomavirus
DCPPLELK

SEQ ID NO: 38049 - protein, 8 aa, Artificial Sequence
  Peptide Derived from Human Papillomavirus
DDTESAHA

SEQ ID NO: 38050 - protein, 9 aa, Artificial Sequence
  Peptide Derived from Human Papillomavirus
DDTESAHAA

SEQ ID NO: 38051 - protein, 11 aa, Artificial Sequence
  Peptide Derived from Human Papillomavirus
DDTESAHAATA

SEQ ID NO: 38052 - protein, 10 aa, Artificial Sequence
  Peptide Derived from Human Papillomavirus
DDYVSRTSIF

SEQ ID NO: 38053 - protein, 11 aa, Artificial Sequence
  Peptide Derived from Human Papillomavirus
DDYVSRTSIFY

SEQ ID NO: 38054 - protein, 9 aa, Artificial Sequence
  Peptide Derived from Human Papillomavirus
DFSTLQDTK

SEQ ID NO: 38055 - protein, 9 aa, Artificial Sequence
  Peptide Derived from Human Papillomavirus
DGDMVDTGY

SEQ ID NO: 38056 - protein, 11 aa, Artificial Sequence
  Peptide Derived from Human Papillomavirus
DGDMVDTGYGA

SEQ ID NO: 38057 - protein, 8 aa, Artificial Sequence
  Peptide Derived from Human Papillomavirus
DICQSICK

SEQ ID NO: 38058 - protein, 9 aa, Artificial Sequence
  Peptide Derived from Human Papillomavirus
DICQSICKY

SEQ ID NO: 38059 - protein, 9 aa, Artificial Sequence
  Peptide Derived from Human Papillomavirus
DLDQYPLGR

SEQ ID NO: 38060 - protein, 10 aa, Artificial Sequence
  Peptide Derived from Human Papillomavirus
DLDQYPLGRK

SEQ ID NO: 38061 - protein, 11 aa, Artificial Sequence
  Peptide Derived from Human Papillomavirus
DLDQYPLGRKF

SEQ ID NO: 38062 - protein, 9 aa, Artificial Sequence
  Peptide Derived from Human Papillomavirus
DLYIKGTSA

SEQ ID NO: 38063 - protein, 9 aa, Artificial Sequence
  Peptide Derived from Human Papillomavirus
DMVDTGYGA

SEQ ID NO: 38064 - protein, 8 aa, Artificial Sequence
  Peptide Derived from Human Papillomavirus
DSMFFCLR

SEQ ID NO: 38065 - protein, 9 aa, Artificial Sequence
  Peptide Derived from Human Papillomavirus
DSMFFCLRR

SEQ ID NO: 38066 - protein, 9 aa, Artificial Sequence
  Peptide Derived from Human Papillomavirus
DSQLFNKPY

SEQ ID NO: 38067 - protein, 11 aa, Artificial Sequence
  Peptide Derived from Human Papillomavirus
DSTIYNPETQR

SEQ ID NO: 38068 - protein, 8 aa, Artificial Sequence
  Peptide Derived from Human Papillomavirus
DTESAHAA

SEQ ID NO: 38069 - protein, 10 aa, Artificial Sequence
  Peptide Derived from Human Papillomavirus
DTESAHAATA

SEQ ID NO: 38070 - protein, 9 aa, Artificial Sequence
  Peptide Derived from Human Papillomavirus
DTGYGAMDF

SEQ ID NO: 38071 - protein, 11 aa, Artificial Sequence
  Peptide Derived from Human Papillomavirus
DTTPPEKQDPY

SEQ ID NO: 38072 - protein, 8 aa, Artificial Sequence
  Peptide Derived from Human Papillomavirus
DTVPTDLY

SEQ ID NO: 38073 - protein, 10 aa, Artificial Sequence
  Peptide Derived from Human Papillomavirus
DTVPTDLYIK

SEQ ID NO: 38074 - protein, 10 aa, Artificial Sequence
  Peptide Derived from Human Papillomavirus
DTYRFVQSVA

SEQ ID NO: 38075 - protein, 10 aa, Artificial Sequence
  Peptide Derived from Human Papillomavirus
DVRDNVSVDY

SEQ ID NO: 38076 - protein, 11 aa, Artificial Sequence
  Peptide Derived from Human Papillomavirus
DVRDNVSVDYK

SEQ ID NO: 38077 - protein, 10 aa, Artificial Sequence
  Peptide Derived from Human Papillomavirus
EDGDMVDTGY

SEQ ID NO: 38078 - protein, 8 aa, Artificial Sequence
  Peptide Derived from Human Papillomavirus
ESAHAATA

SEQ ID NO: 38079 - protein, 8 aa, Artificial Sequence
  Peptide Derived from Human Papillomavirus
ETPGSCVY

SEQ ID NO: 38080 - protein, 8 aa, Artificial Sequence
  Peptide Derived from Human Papillomavirus
ETQRLVWA

SEQ ID NO: 38081 - protein, 8 aa, Artificial Sequence
  Peptide Derived from Human Papillomavirus
FARHFWNR

SEQ ID NO: 38082 - protein, 9 aa, Artificial Sequence
  Peptide Derived from Human Papillomavirus
FARHFWNRA

SEQ ID NO: 38083 - protein, 9 aa, Artificial Sequence
  Peptide Derived from Human Papillomavirus
FCLRREQLF

SEQ ID NO: 38084 - protein, 10 aa, Artificial Sequence
  Peptide Derived from Human Papillomavirus
FCLRREQLFA

SEQ ID NO: 38085 - protein, 11 aa, Artificial Sequence
  Peptide Derived from Human Papillomavirus
FCLRREQLFAR

SEQ ID NO: 38086 - protein, 10 aa, Artificial Sequence
  Peptide Derived from Human Papillomavirus
FFCLRREQLF

SEQ ID NO: 38087 - protein, 11 aa, Artificial Sequence
  Peptide Derived from Human Papillomavirus
FFCLRREQLFA

SEQ ID NO: 38088 - protein, 9 aa, Artificial Sequence
  Peptide Derived from Human Papillomavirus
FGLPDSTIY

SEQ ID NO: 38089 - protein, 8 aa, Artificial Sequence
  Peptide Derived from Human Papillomavirus
FLKNVNVF

SEQ ID NO: 38090 - protein, 11 aa, Artificial Sequence
  Peptide Derived from Human Papillomavirus
FLKNVNVFPIF

SEQ ID NO: 38091 - protein, 8 aa, Artificial Sequence
  Peptide Derived from Human Papillomavirus
FLQMALWR

SEQ ID NO: 38092 - protein, 8 aa, Artificial Sequence
  Peptide Derived from Human Papillomavirus
FLVQAGLR

SEQ ID NO: 38093 - protein, 9 aa, Artificial Sequence
  Peptide Derived from Human Papillomavirus
FLVQAGLRR

SEQ ID NO: 38094 - protein, 10 aa, Artificial Sequence
  Peptide Derived from Human Papillomavirus
FLVQAGLRRR

SEQ ID NO: 38095 - protein, 8 aa, Artificial Sequence
  Peptide Derived from Human Papillomavirus
FSSDLDQY

SEQ ID NO: 38096 - protein, 8 aa, Artificial Sequence
  Peptide Derived from Human Papillomavirus
FSTLQDTK

SEQ ID NO: 38097 - protein, 11 aa, Artificial Sequence
  Peptide Derived from Human Papillomavirus
FVQSVAVTCQK

SEQ ID NO: 38098 - protein, 9 aa, Artificial Sequence
  Peptide Derived from Human Papillomavirus
FVTVVDTTR

SEQ ID NO: 38099 - protein, 10 aa, Artificial Sequence
  Peptide Derived from Human Papillomavirus
GAGNKQAVPK

SEQ ID NO: 38100 - protein, 9 aa, Artificial Sequence
  Peptide Derived from Human Papillomavirus
GCVPAIGEH

SEQ ID NO: 38101 - protein, 11 aa, Artificial Sequence
  Peptide Derived from Human Papillomavirus
GCVPAIGEHWA

SEQ ID NO: 38102 - protein, 9 aa, Artificial Sequence
  Peptide Derived from Human Papillomavirus
GDCPPLELK

SEQ ID NO: 38103 - protein, 8 aa, Artificial Sequence
  Peptide Derived from Human Papillomavirus
GDMVDTGY

SEQ ID NO: 38104 - protein, 10 aa, Artificial Sequence
  Peptide Derived from Human Papillomavirus
GDMVDTGYGA

SEQ ID NO: 38105 - protein, 9 aa, Artificial Sequence
  Peptide Derived from Human Papillomavirus
GDSMFFCLR

SEQ ID NO: 38106 - protein, 10 aa, Artificial Sequence
  Peptide Derived from Human Papillomavirus
GDSMFFCLRR

SEQ ID NO: 38107 - protein, 9 aa, Artificial Sequence
  Peptide Derived from Human Papillomavirus
GDTVPTDLY

SEQ ID NO: 38108 - protein, 11 aa, Artificial Sequence
  Peptide Derived from Human Papillomavirus
GDTVPTDLYIK

SEQ ID NO: 38109 - protein, 9 aa, Artificial Sequence
  Peptide Derived from Human Papillomavirus
GICWHNQLF

SEQ ID NO: 38110 - protein, 9 aa, Artificial Sequence
  Peptide Derived from Human Papillomavirus
GIGLSGHPF

SEQ ID NO: 38111 - protein, 10 aa, Artificial Sequence
  Peptide Derived from Human Papillomavirus
GIGLSGHPFY

SEQ ID NO: 38112 - protein, 8 aa, Artificial Sequence
  Peptide Derived from Human Papillomavirus
GLPDSTIY

SEQ ID NO: 38113 - protein, 11 aa, Artificial Sequence
  Peptide Derived from Human Papillomavirus
GLRRRPTIGPR

SEQ ID NO: 38114 - protein, 8 aa, Artificial Sequence
  Peptide Derived from Human Papillomavirus
GLSGHPFY

SEQ ID NO: 38115 - protein, 10 aa, Artificial Sequence
  Peptide Derived from Human Papillomavirus
GLSGHPFYNK

SEQ ID NO: 38116 - protein, 11 aa, Artificial Sequence
  Peptide Derived from Human Papillomavirus
GSITTSDSQLF

SEQ ID NO: 38117 - protein, 8 aa, Artificial Sequence
  Peptide Derived from Human Papillomavirus
HGIIIFLK

SEQ ID NO: 38118 - protein, 9 aa, Artificial Sequence
  Peptide Derived from Human Papillomavirus
HVEEYDLQF

SEQ ID NO: 38119 - protein, 11 aa, Artificial Sequence
  Peptide Derived from Human Papillomavirus
HVEEYDLQFIF

SEQ ID NO: 38120 - protein, 8 aa, Artificial Sequence
  Peptide Derived from Human Papillomavirus
ICQSICKY

SEQ ID NO: 38121 - protein, 11 aa, Artificial Sequence
  Peptide Derived from Human Papillomavirus
ICQSICKYPDY

SEQ ID NO: 38122 - protein, 8 aa, Artificial Sequence
  Peptide Derived from Human Papillomavirus
ICWHNQLF

SEQ ID NO: 38123 - protein, 9 aa, Artificial Sequence
  Peptide Derived from Human Papillomavirus
IFLKNVNVF

SEQ ID NO: 38124 - protein, 9 aa, Artificial Sequence
  Peptide Derived from Human Papillomavirus
IFLQMALWR

SEQ ID NO: 38125 - protein, 11 aa, Artificial Sequence
  Peptide Derived from Human Papillomavirus
IFQLCTITLTA

SEQ ID NO: 38126 - protein, 9 aa, Artificial Sequence
  Peptide Derived from Human Papillomavirus
IFYHAGSSR

SEQ ID NO: 38127 - protein, 8 aa, Artificial Sequence
  Peptide Derived from Human Papillomavirus
IGLSGHPF

SEQ ID NO: 38128 - protein, 9 aa, Artificial Sequence
  Peptide Derived from Human Papillomavirus
IGLSGHPFY

SEQ ID NO: 38129 - protein, 11 aa, Artificial Sequence
  Peptide Derived from Human Papillomavirus
IGLSGHPFYNK

SEQ ID NO: 38130 - protein, 8 aa, Artificial Sequence
  Peptide Derived from Human Papillomavirus
IGPRKRPA

SEQ ID NO: 38131 - protein, 9 aa, Artificial Sequence
  Peptide Derived from Human Papillomavirus
IGPRKRPAA

SEQ ID NO: 38132 - protein, 10 aa, Artificial Sequence
  Peptide Derived from Human Papillomavirus
IIFLKNVNVF

SEQ ID NO: 38133 - protein, 11 aa, Artificial Sequence
  Peptide Derived from Human Papillomavirus
IIIFLKNVNVF

SEQ ID NO: 38134 - protein, 10 aa, Artificial Sequence
  Peptide Derived from Human Papillomavirus
IIYGHGIIIF

SEQ ID NO: 38135 - protein, 11 aa, Artificial Sequence
  Peptide Derived from Human Papillomavirus
ILGCVPAIGEH

SEQ ID NO: 38136 - protein, 10 aa, Artificial Sequence
  Peptide Derived from Human Papillomavirus
ITLTAEVMSY

SEQ ID NO: 38137 - protein, 9 aa, Artificial Sequence
  Peptide Derived from Human Papillomavirus
ITTSDSQLF

SEQ ID NO: 38138 - protein, 11 aa, Artificial Sequence
  Peptide Derived from Human Papillomavirus
ITTSDSQLFNK

SEQ ID NO: 38139 - protein, 8 aa, Artificial Sequence
  Peptide Derived from Human Papillomavirus
KDTTPPEK

SEQ ID NO: 38140 - protein, 10 aa, Artificial Sequence
  Peptide Derived from Human Papillomavirus
KFGLPDSTIY

SEQ ID NO: 38141 - protein, 8 aa, Artificial Sequence
  Peptide Derived from Human Papillomavirus
KFKHYSRH

SEQ ID NO: 38142 - protein, 9 aa, Artificial Sequence
  Peptide Derived from Human Papillomavirus
KFLVQAGLR

SEQ ID NO: 38143 - protein, 10 aa, Artificial Sequence
  Peptide Derived from Human Papillomavirus
KFLVQAGLRR

SEQ ID NO: 38144 - protein, 11 aa, Artificial Sequence
  Peptide Derived from Human Papillomavirus
KFLVQAGLRRR

SEQ ID NO: 38145 - protein, 9 aa, Artificial Sequence
  Peptide Derived from Human Papillomavirus
KFSSDLDQY

SEQ ID NO: 38146 - protein, 8 aa, Artificial Sequence
  Peptide Derived from Human Papillomavirus
KFWTVDLK

SEQ ID NO: 38147 - protein, 10 aa, Artificial Sequence
  Peptide Derived from Human Papillomavirus
KFWTVDLKEK

SEQ ID NO: 38148 - protein, 11 aa, Artificial Sequence
  Peptide Derived from Human Papillomavirus
KFWTVDLKEKF

SEQ ID NO: 38149 - protein, 8 aa, Artificial Sequence
  Peptide Derived from Human Papillomavirus
KGTLCKPA

SEQ ID NO: 38150 - protein, 8 aa, Artificial Sequence
  Peptide Derived from Human Papillomavirus
KGTSANMR

SEQ ID NO: 38151 - protein, 8 aa, Artificial Sequence
  Peptide Derived from Human Papillomavirus
KLDDTESA

SEQ ID NO: 38152 - protein, 9 aa, Artificial Sequence
  Peptide Derived from Human Papillomavirus
KLDDTESAH

SEQ ID NO: 38153 - protein, 10 aa, Artificial Sequence
  Peptide Derived from Human Papillomavirus
KLDDTESAHA

SEQ ID NO: 38154 - protein, 11 aa, Artificial Sequence
  Peptide Derived from Human Papillomavirus
KLDDTESAHAA

SEQ ID NO: 38155 - protein, 10 aa, Artificial Sequence
  Peptide Derived from Human Papillomavirus
KLKFWTVDLK

SEQ ID NO: 38156 - protein, 8 aa, Artificial Sequence
  Peptide Derived from Human Papillomavirus
KVSAYQYR

SEQ ID NO: 38157 - protein, 10 aa, Artificial Sequence
  Peptide Derived from Human Papillomavirus
KVSAYQYRVF

SEQ ID NO: 38158 - protein, 11 aa, Artificial Sequence
  Peptide Derived from Human Papillomavirus
KVSAYQYRVFR

SEQ ID NO: 38159 - protein, 9 aa, Artificial Sequence
  Peptide Derived from Human Papillomavirus
LCILGCVPA

SEQ ID NO: 38160 - protein, 8 aa, Artificial Sequence
  Peptide Derived from Human Papillomavirus
LCTITLTA

SEQ ID NO: 38161 - protein, 8 aa, Artificial Sequence
  Peptide Derived from Human Papillomavirus
LDDTESAH

SEQ ID NO: 38162 - protein, 9 aa, Artificial Sequence
  Peptide Derived from Human Papillomavirus
LDDTESAHA

SEQ ID NO: 38163 - protein, 10 aa, Artificial Sequence
  Peptide Derived from Human Papillomavirus
LDDTESAHAA

SEQ ID NO: 38164 - protein, 9 aa, Artificial Sequence
  Peptide Derived from Human Papillomavirus
LDICQSICK

SEQ ID NO: 38165 - protein, 10 aa, Artificial Sequence
  Peptide Derived from Human Papillomavirus
LDICQSICKY

SEQ ID NO: 38166 - protein, 8 aa, Artificial Sequence
  Peptide Derived from Human Papillomavirus
LDQYPLGR

SEQ ID NO: 38167 - protein, 9 aa, Artificial Sequence
  Peptide Derived from Human Papillomavirus
LDQYPLGRK

SEQ ID NO: 38168 - protein, 10 aa, Artificial Sequence
  Peptide Derived from Human Papillomavirus
LDQYPLGRKF

SEQ ID NO: 38169 - protein, 9 aa, Artificial Sequence
  Peptide Derived from Human Papillomavirus
LFARHFWNR

SEQ ID NO: 38170 - protein, 10 aa, Artificial Sequence
  Peptide Derived from Human Papillomavirus
LFARHFWNRA

SEQ ID NO: 38171 - protein, 9 aa, Artificial Sequence
  Peptide Derived from Human Papillomavirus
LFNKPYWLH

SEQ ID NO: 38172 - protein, 10 aa, Artificial Sequence
  Peptide Derived from Human Papillomavirus
LFNKPYWLHK

SEQ ID NO: 38173 - protein, 11 aa, Artificial Sequence
  Peptide Derived from Human Papillomavirus
LFNKPYWLHKA

SEQ ID NO: 38174 - protein, 10 aa, Artificial Sequence
  Peptide Derived from Human Papillomavirus
LFVTVVDTTR

SEQ ID NO: 38175 - protein, 10 aa, Artificial Sequence
  Peptide Derived from Human Papillomavirus
LGCVPAIGEH

SEQ ID NO: 38176 - protein, 8 aa, Artificial Sequence
  Peptide Derived from Human Papillomavirus
LGIGLSGH

SEQ ID NO: 38177 - protein, 10 aa, Artificial Sequence
  Peptide Derived from Human Papillomavirus
LGIGLSGHPF

SEQ ID NO: 38178 - protein, 11 aa, Artificial Sequence
  Peptide Derived from Human Papillomavirus
LGIGLSGHPFY

SEQ ID NO: 38179 - protein, 9 aa, Artificial Sequence
  Peptide Derived from Human Papillomavirus
LGRKFLVQA

SEQ ID NO: 38180 - protein, 8 aa, Artificial Sequence
  Peptide Derived from Human Papillomavirus
LLTVGNPY

SEQ ID NO: 38181 - protein, 9 aa, Artificial Sequence
  Peptide Derived from Human Papillomavirus
LLTVGNPYF

SEQ ID NO: 38182 - protein, 10 aa, Artificial Sequence
  Peptide Derived from Human Papillomavirus
LLTVGNPYFR

SEQ ID NO: 38183 - protein, 9 aa, Artificial Sequence
  Peptide Derived from Human Papillomavirus
LSGHPFYNK

SEQ ID NO: 38184 - protein, 8 aa, Artificial Sequence
  Peptide Derived from Human Papillomavirus
LTAEVMSY

SEQ ID NO: 38185 - protein, 10 aa, Artificial Sequence
  Peptide Derived from Human Papillomavirus
LTAEVMSYIH

SEQ ID NO: 38186 - protein, 8 aa, Artificial Sequence
  Peptide Derived from Human Papillomavirus
LTVGNPYF

SEQ ID NO: 38187 - protein, 9 aa, Artificial Sequence
  Peptide Derived from Human Papillomavirus
LTVGNPYFR

SEQ ID NO: 38188 - protein, 8 aa, Artificial Sequence
  Peptide Derived from Human Papillomavirus
LVQAGLRR

SEQ ID NO: 38189 - protein, 9 aa, Artificial Sequence
  Peptide Derived from Human Papillomavirus
LVQAGLRRR

SEQ ID NO: 38190 - protein, 9 aa, Artificial Sequence
  Peptide Derived from Human Papillomavirus
MAHNIIYGH

SEQ ID NO: 38191 - protein, 10 aa, Artificial Sequence
  Peptide Derived from Human Papillomavirus
MDFSTLQDTK

SEQ ID NO: 38192 - protein, 11 aa, Artificial Sequence
  Peptide Derived from Human Papillomavirus
MFFCLRREQLF

SEQ ID NO: 38193 - protein, 10 aa, Artificial Sequence
  Peptide Derived from Human Papillomavirus
MGDTVPTDLY

SEQ ID NO: 38194 - protein, 11 aa, Artificial Sequence
  Peptide Derived from Human Papillomavirus
MSADPYGDSMF

SEQ ID NO: 38195 - protein, 8 aa, Artificial Sequence
  Peptide Derived from Human Papillomavirus
MVDTGYGA

SEQ ID NO: 38196 - protein, 11 aa, Artificial Sequence
  Peptide Derived from Human Papillomavirus
MVDTGYGAMDF

SEQ ID NO: 38197 - protein, 10 aa, Artificial Sequence
  Peptide Derived from Human Papillomavirus
NGICWHNQLF

SEQ ID NO: 38198 - protein, 11 aa, Artificial Sequence
  Peptide Derived from Human Papillomavirus
NIIYGHGIIIF

SEQ ID NO: 38199 - protein, 11 aa, Artificial Sequence
  Peptide Derived from Human Papillomavirus
NMRETPGSCVY

SEQ ID NO: 38200 - protein, 10 aa, Artificial Sequence
  Peptide Derived from Human Papillomavirus
NSSILENWNF

SEQ ID NO: 38201 - protein, 8 aa, Artificial Sequence
  Peptide Derived from Human Papillomavirus
NTDDYVSR

SEQ ID NO: 38202 - protein, 8 aa, Artificial Sequence
  Peptide Derived from Human Papillomavirus
NTYDPTKF

SEQ ID NO: 38203 - protein, 9 aa, Artificial Sequence
  Peptide Derived from Human Papillomavirus
NTYDPTKFK

SEQ ID NO: 38204 - protein, 10 aa, Artificial Sequence
  Peptide Derived from Human Papillomavirus
NTYDPTKFKH

SEQ ID NO: 38205 - protein, 11 aa, Artificial Sequence
  Peptide Derived from Human Papillomavirus
NTYDPTKFKHY

SEQ ID NO: 38206 - protein, 10 aa, Artificial Sequence
  Peptide Derived from Human Papillomavirus
NVFPIFLQMA

SEQ ID NO: 38207 - protein, 8 aa, Artificial Sequence
  Peptide Derived from Human Papillomavirus
NVNVFPIF

SEQ ID NO: 38208 - protein, 8 aa, Artificial Sequence
  Peptide Derived from Human Papillomavirus
PAASTSTA

SEQ ID NO: 38209 - protein, 10 aa, Artificial Sequence
  Peptide Derived from Human Papillomavirus
PAASTSTASR

SEQ ID NO: 38210 - protein, 8 aa, Artificial Sequence
  Peptide Derived from Human Papillomavirus
PAIGEHWA

SEQ ID NO: 38211 - protein, 9 aa, Artificial Sequence
  Peptide Derived from Human Papillomavirus
PAIGEHWAK

SEQ ID NO: 38212 - protein, 8 aa, Artificial Sequence
  Peptide Derived from Human Papillomavirus
PAKRVRIR

SEQ ID NO: 38213 - protein, 10 aa, Artificial Sequence
  Peptide Derived from Human Papillomavirus
PAKRVRIRSK

SEQ ID NO: 38214 - protein, 11 aa, Artificial Sequence
  Peptide Derived from Human Papillomavirus
PAKRVRIRSKK

SEQ ID NO: 38215 - protein, 8 aa, Artificial Sequence
  Peptide Derived from Human Papillomavirus
PDYLQMSA

SEQ ID NO: 38216 - protein, 11 aa, Artificial Sequence
  Peptide Derived from Human Papillomavirus
PDYLQMSADPY

SEQ ID NO: 38217 - protein, 10 aa, Artificial Sequence
  Peptide Derived from Human Papillomavirus
PGDCPPLELK

SEQ ID NO: 38218 - protein, 10 aa, Artificial Sequence
  Peptide Derived from Human Papillomavirus
PIFLQMALWR

SEQ ID NO: 38219 - protein, 10 aa, Artificial Sequence
  Peptide Derived from Human Papillomavirus
PLDICQSICK

SEQ ID NO: 38220 - protein, 11 aa, Artificial Sequence
  Peptide Derived from Human Papillomavirus
PLDICQSICKY

SEQ ID NO: 38221 - protein, 9 aa, Artificial Sequence
  Peptide Derived from Human Papillomavirus
PLGIGLSGH

SEQ ID NO: 38222 - protein, 11 aa, Artificial Sequence
  Peptide Derived from Human Papillomavirus
PLGIGLSGHPF

SEQ ID NO: 38223 - protein, 10 aa, Artificial Sequence
  Peptide Derived from Human Papillomavirus
PLGRKFLVQA

SEQ ID NO: 38224 - protein, 9 aa, Artificial Sequence
  Peptide Derived from Human Papillomavirus
PSGAGNKQA

SEQ ID NO: 38225 - protein, 11 aa, Artificial Sequence
  Peptide Derived from Human Papillomavirus
PTDLYIKGTSA

SEQ ID NO: 38226 - protein, 8 aa, Artificial Sequence
  Peptide Derived from Human Papillomavirus
PTIGPRKR

SEQ ID NO: 38227 - protein, 10 aa, Artificial Sequence
  Peptide Derived from Human Papillomavirus
PTIGPRKRPA

SEQ ID NO: 38228 - protein, 11 aa, Artificial Sequence
  Peptide Derived from Human Papillomavirus
PTIGPRKRPAA

SEQ ID NO: 38229 - protein, 9 aa, Artificial Sequence
  Peptide Derived from Human Papillomavirus
PTKFKHYSR

SEQ ID NO: 38230 - protein, 10 aa, Artificial Sequence
  Peptide Derived from Human Papillomavirus
PTKFKHYSRH

SEQ ID NO: 38231 - protein, 9 aa, Artificial Sequence
  Peptide Derived from Human Papillomavirus
PTTSLVDTY

SEQ ID NO: 38232 - protein, 10 aa, Artificial Sequence
  Peptide Derived from Human Papillomavirus
PTTSLVDTYR

SEQ ID NO: 38233 - protein, 11 aa, Artificial Sequence
  Peptide Derived from Human Papillomavirus
PTTSLVDTYRF

SEQ ID NO: 38234 - protein, 10 aa, Artificial Sequence
  Peptide Derived from Human Papillomavirus
PVPNTYDPTK

SEQ ID NO: 38235 - protein, 11 aa, Artificial Sequence
  Peptide Derived from Human Papillomavirus
PVPNTYDPTKF

SEQ ID NO: 38236 - protein, 8 aa, Artificial Sequence
  Peptide Derived from Human Papillomavirus
QAVPKVSA

SEQ ID NO: 38237 - protein, 9 aa, Artificial Sequence
  Peptide Derived from Human Papillomavirus
QAVPKVSAY

SEQ ID NO: 38238 - protein, 11 aa, Artificial Sequence
  Peptide Derived from Human Papillomavirus
QAVPKVSAYQY

SEQ ID NO: 38239 - protein, 8 aa, Artificial Sequence
  Peptide Derived from Human Papillomavirus
QDPYDKLK

SEQ ID NO: 38240 - protein, 9 aa, Artificial Sequence
  Peptide Derived from Human Papillomavirus
QDPYDKLKF

SEQ ID NO: 38241 - protein, 11 aa, Artificial Sequence
  Peptide Derived from Human Papillomavirus
QDVRDNVSVDY

SEQ ID NO: 38242 - protein, 10 aa, Artificial Sequence
  Peptide Derived from Human Papillomavirus
QGHNNGICWH

SEQ ID NO: 38243 - protein, 10 aa, Artificial Sequence
  Peptide Derived from Human Papillomavirus
QLCILGCVPA

SEQ ID NO: 38244 - protein, 9 aa, Artificial Sequence
  Peptide Derived from Human Papillomavirus
QLCTITLTA

SEQ ID NO: 38245 - protein, 10 aa, Artificial Sequence
  Peptide Derived from Human Papillomavirus
QLFARHFWNR

SEQ ID NO: 38246 - protein, 11 aa, Artificial Sequence
  Peptide Derived from Human Papillomavirus
QLFARHFWNRA

SEQ ID NO: 38247 - protein, 10 aa, Artificial Sequence
  Peptide Derived from Human Papillomavirus
QLFNKPYWLH

SEQ ID NO: 38248 - protein, 11 aa, Artificial Sequence
  Peptide Derived from Human Papillomavirus
QLFNKPYWLHK

SEQ ID NO: 38249 - protein, 11 aa, Artificial Sequence
  Peptide Derived from Human Papillomavirus
QLFVTVVDTTR

SEQ ID NO: 38250 - protein, 9 aa, Artificial Sequence
  Peptide Derived from Human Papillomavirus
QSICKYPDY

SEQ ID NO: 38251 - protein, 9 aa, Artificial Sequence
  Peptide Derived from Human Papillomavirus
QSVAVTCQK

SEQ ID NO: 38252 - protein, 8 aa, Artificial Sequence
  Peptide Derived from Human Papillomavirus
RDNVSVDY

SEQ ID NO: 38253 - protein, 9 aa, Artificial Sequence
  Peptide Derived from Human Papillomavirus
RDNVSVDYK

SEQ ID NO: 38254 - protein, 9 aa, Artificial Sequence
  Peptide Derived from Human Papillomavirus
RLLTVGNPY

SEQ ID NO: 38255 - protein, 10 aa, Artificial Sequence
  Peptide Derived from Human Papillomavirus
RLLTVGNPYF

SEQ ID NO: 38256 - protein, 11 aa, Artificial Sequence
  Peptide Derived from Human Papillomavirus
RLLTVGNPYFR

SEQ ID NO: 38257 - protein, 9 aa, Artificial Sequence
  Peptide Derived from Human Papillomavirus
RSTNLTLCA

SEQ ID NO: 38258 - protein, 8 aa, Artificial Sequence
  Peptide Derived from Human Papillomavirus
RTSIFYHA

SEQ ID NO: 38259 - protein, 9 aa, Artificial Sequence
  Peptide Derived from Human Papillomavirus
RVALPDPNK

SEQ ID NO: 38260 - protein, 10 aa, Artificial Sequence
  Peptide Derived from Human Papillomavirus
RVALPDPNKF

SEQ ID NO: 38261 - protein, 8 aa, Artificial Sequence
  Peptide Derived from Human Papillomavirus
RVRIRSKK

SEQ ID NO: 38262 - protein, 8 aa, Artificial Sequence
  Peptide Derived from Human Papillomavirus
RVVNTDDY

SEQ ID NO: 38263 - protein, 11 aa, Artificial Sequence
  Peptide Derived from Human Papillomavirus
RVVNTDDYVSR

SEQ ID NO: 38264 - protein, 10 aa, Artificial Sequence
  Peptide Derived from Human Papillomavirus
RVVPSGAGNK

SEQ ID NO: 38265 - protein, 10 aa, Artificial Sequence
  Peptide Derived from Human Papillomavirus
SADPYGDSMF

SEQ ID NO: 38266 - protein, 11 aa, Artificial Sequence
  Peptide Derived from Human Papillomavirus
SADPYGDSMFF

SEQ ID NO: 38267 - protein, 8 aa, Artificial Sequence
  Peptide Derived from Human Papillomavirus
SAYQYRVF

SEQ ID NO: 38268 - protein, 9 aa, Artificial Sequence
  Peptide Derived from Human Papillomavirus
SAYQYRVFR

SEQ ID NO: 38269 - protein, 11 aa, Artificial Sequence
  Peptide Derived from Human Papillomavirus
SAYQYRVFRVA

SEQ ID NO: 38270 - protein, 10 aa, Artificial Sequence
  Peptide Derived from Human Papillomavirus
SDLDQYPLGR

SEQ ID NO: 38271 - protein, 11 aa, Artificial Sequence
  Peptide Derived from Human Papillomavirus
SDLDQYPLGRK

SEQ ID NO: 38272 - protein, 8 aa, Artificial Sequence
  Peptide Derived from Human Papillomavirus
SDSQLFNK

SEQ ID NO: 38273 - protein, 10 aa, Artificial Sequence
  Peptide Derived from Human Papillomavirus
SDSQLFNKPY

SEQ ID NO: 38274 - protein, 8 aa, Artificial Sequence
  Peptide Derived from Human Papillomavirus
SGAGNKQA

SEQ ID NO: 38275 - protein, 11 aa, Artificial Sequence
  Peptide Derived from Human Papillomavirus
SGAGNKQAVPK

SEQ ID NO: 38276 - protein, 8 aa, Artificial Sequence
  Peptide Derived from Human Papillomavirus
SGHPFYNK

SEQ ID NO: 38277 - protein, 8 aa, Artificial Sequence
  Peptide Derived from Human Papillomavirus
SICKYPDY

SEQ ID NO: 38278 - protein, 10 aa, Artificial Sequence
  Peptide Derived from Human Papillomavirus
SIFYHAGSSR

SEQ ID NO: 38279 - protein, 8 aa, Artificial Sequence
  Peptide Derived from Human Papillomavirus
SILENWNF

SEQ ID NO: 38280 - protein, 10 aa, Artificial Sequence
  Peptide Derived from Human Papillomavirus
SITTSDSQLF

SEQ ID NO: 38281 - protein, 8 aa, Artificial Sequence
  Peptide Derived from Human Papillomavirus
SLVDTYRF

SEQ ID NO: 38282 - protein, 8 aa, Artificial Sequence
  Peptide Derived from Human Papillomavirus
SMFFCLRR

SEQ ID NO: 38283 - protein, 11 aa, Artificial Sequence
  Peptide Derived from Human Papillomavirus
SSDLDQYPLGR

SEQ ID NO: 38284 - protein, 9 aa, Artificial Sequence
  Peptide Derived from Human Papillomavirus
SSILENWNF

SEQ ID NO: 38285 - protein, 11 aa, Artificial Sequence
  Peptide Derived from Human Papillomavirus
SSRLLTVGNPY

SEQ ID NO: 38286 - protein, 8 aa, Artificial Sequence
  Peptide Derived from Human Papillomavirus
STASRPAK

SEQ ID NO: 38287 - protein, 9 aa, Artificial Sequence
  Peptide Derived from Human Papillomavirus
STASRPAKR

SEQ ID NO: 38288 - protein, 11 aa, Artificial Sequence
  Peptide Derived from Human Papillomavirus
STASRPAKRVR

SEQ ID NO: 38289 - protein, 10 aa, Artificial Sequence
  Peptide Derived from Human Papillomavirus
STIYNPETQR

SEQ ID NO: 38290 - protein, 8 aa, Artificial Sequence
  Peptide Derived from Human Papillomavirus
STNLTLCA

SEQ ID NO: 38291 - protein, 10 aa, Artificial Sequence
  Peptide Derived from Human Papillomavirus
STQNPVPNTY

SEQ ID NO: 38292 - protein, 9 aa, Artificial Sequence
  Peptide Derived from Human Papillomavirus
STSTASRPA

SEQ ID NO: 38293 - protein, 10 aa, Artificial Sequence
  Peptide Derived from Human Papillomavirus
STSTASRPAK

SEQ ID NO: 38294 - protein, 11 aa, Artificial Sequence
  Peptide Derived from Human Papillomavirus
STSTASRPAKR

SEQ ID NO: 38295 - protein, 11 aa, Artificial Sequence
  Peptide Derived from Human Papillomavirus
STVYLPPPSVA

SEQ ID NO: 38296 - protein, 11 aa, Artificial Sequence
  Peptide Derived from Human Papillomavirus
SVARVVNTDDY

SEQ ID NO: 38297 - protein, 8 aa, Artificial Sequence
  Peptide Derived from Human Papillomavirus
SVAVTCQK

SEQ ID NO: 38298 - protein, 9 aa, Artificial Sequence
  Peptide Derived from Human Papillomavirus
TAEVMSYIH

SEQ ID NO: 38299 - protein, 8 aa, Artificial Sequence
  Peptide Derived from Human Papillomavirus
TASRPAKR

SEQ ID NO: 38300 - protein, 10 aa, Artificial Sequence
  Peptide Derived from Human Papillomavirus
TASRPAKRVR

SEQ ID NO: 38301 - protein, 9 aa, Artificial Sequence
  Peptide Derived from Human Papillomavirus
TAVITQDVR

SEQ ID NO: 38302 - protein, 11 aa, Artificial Sequence
  Peptide Derived from Human Papillomavirus
TCQKDTTPPEK

SEQ ID NO: 38303 - protein, 11 aa, Artificial Sequence
  Peptide Derived from Human Papillomavirus
TDDYVSRTSIF

SEQ ID NO: 38304 - protein, 10 aa, Artificial Sequence
  Peptide Derived from Human Papillomavirus
TDLYIKGTSA

SEQ ID NO: 38305 - protein, 8 aa, Artificial Sequence
  Peptide Derived from Human Papillomavirus
TGYGAMDF

SEQ ID NO: 38306 - protein, 9 aa, Artificial Sequence
  Peptide Derived from Human Papillomavirus
TIGPRKRPA

SEQ ID NO: 38307 - protein, 10 aa, Artificial Sequence
  Peptide Derived from Human Papillomavirus
TIGPRKRPAA

SEQ ID NO: 38308 - protein, 11 aa, Artificial Sequence
  Peptide Derived from Human Papillomavirus
TITLTAEVMSY

SEQ ID NO: 38309 - protein, 9 aa, Artificial Sequence
  Peptide Derived from Human Papillomavirus
TIYNPETQR

SEQ ID NO: 38310 - protein, 9 aa, Artificial Sequence
  Peptide Derived from Human Papillomavirus
TLTAEVMSY

SEQ ID NO: 38311 - protein, 11 aa, Artificial Sequence
  Peptide Derived from Human Papillomavirus
TLTAEVMSYIH

SEQ ID NO: 38312 - protein, 9 aa, Artificial Sequence
  Peptide Derived from Human Papillomavirus
TSDSQLFNK

SEQ ID NO: 38313 - protein, 11 aa, Artificial Sequence
  Peptide Derived from Human Papillomavirus
TSDSQLFNKPY

SEQ ID NO: 38314 - protein, 11 aa, Artificial Sequence
  Peptide Derived from Human Papillomavirus
TSIFYHAGSSR

SEQ ID NO: 38315 - protein, 8 aa, Artificial Sequence
  Peptide Derived from Human Papillomavirus
TSLVDTYR

SEQ ID NO: 38316 - protein, 9 aa, Artificial Sequence
  Peptide Derived from Human Papillomavirus
TSLVDTYRF

SEQ ID NO: 38317 - protein, 8 aa, Artificial Sequence
  Peptide Derived from Human Papillomavirus
TSTASRPA

SEQ ID NO: 38318 - protein, 9 aa, Artificial Sequence
  Peptide Derived from Human Papillomavirus
TSTASRPAK

SEQ ID NO: 38319 - protein, 10 aa, Artificial Sequence
  Peptide Derived from Human Papillomavirus
TSTASRPAKR

SEQ ID NO: 38320 - protein, 10 aa, Artificial Sequence
  Peptide Derived from Human Papillomavirus
TTPPEKQDPY

SEQ ID NO: 38321 - protein, 11 aa, Artificial Sequence
  Peptide Derived from Human Papillomavirus
TTRSTNLTLCA

SEQ ID NO: 38322 - protein, 8 aa, Artificial Sequence
  Peptide Derived from Human Papillomavirus
TTSDSQLF

SEQ ID NO: 38323 - protein, 10 aa, Artificial Sequence
  Peptide Derived from Human Papillomavirus
TTSDSQLFNK

SEQ ID NO: 38324 - protein, 8 aa, Artificial Sequence
  Peptide Derived from Human Papillomavirus
TTSLVDTY

SEQ ID NO: 38325 - protein, 9 aa, Artificial Sequence
  Peptide Derived from Human Papillomavirus
TTSLVDTYR

SEQ ID NO: 38326 - protein, 10 aa, Artificial Sequence
  Peptide Derived from Human Papillomavirus
TTSLVDTYRF

SEQ ID NO: 38327 - protein, 8 aa, Artificial Sequence
  Peptide Derived from Human Papillomavirus
TVDLKEKF

SEQ ID NO: 38328 - protein, 8 aa, Artificial Sequence
  Peptide Derived from Human Papillomavirus
TVGNPYFR

SEQ ID NO: 38329 - protein, 9 aa, Artificial Sequence
  Peptide Derived from Human Papillomavirus
TVPTDLYIK

SEQ ID NO: 38330 - protein, 10 aa, Artificial Sequence
  Peptide Derived from Human Papillomavirus
TVYLPPPSVA

SEQ ID NO: 38331 - protein, 11 aa, Artificial Sequence
  Peptide Derived from Human Papillomavirus
TVYLPPPSVAR

SEQ ID NO: 38332 - protein, 8 aa, Artificial Sequence
  Peptide Derived from Human Papillomavirus
VALPDPNK

SEQ ID NO: 38333 - protein, 9 aa, Artificial Sequence
  Peptide Derived from Human Papillomavirus
VALPDPNKF

SEQ ID NO: 38334 - protein, 10 aa, Artificial Sequence
  Peptide Derived from Human Papillomavirus
VARVVNTDDY

SEQ ID NO: 38335 - protein, 10 aa, Artificial Sequence
  Peptide Derived from Human Papillomavirus
VDTGYGAMDF

SEQ ID NO: 38336 - protein, 11 aa, Artificial Sequence
  Peptide Derived from Human Papillomavirus
VDTYRFVQSVA

SEQ ID NO: 38337 - protein, 9 aa, Artificial Sequence
  Peptide Derived from Human Papillomavirus
VFPIFLQMA

SEQ ID NO: 38338 - protein, 11 aa, Artificial Sequence
  Peptide Derived from Human Papillomavirus
VFRVALPDPNK

SEQ ID NO: 38339 - protein, 11 aa, Artificial Sequence
  Peptide Derived from Human Papillomavirus
VMGDTVPTDLY

SEQ ID NO: 38340 - protein, 9 aa, Artificial Sequence
  Peptide Derived from Human Papillomavirus
VSAYQYRVF

SEQ ID NO: 38341 - protein, 10 aa, Artificial Sequence
  Peptide Derived from Human Papillomavirus
VSAYQYRVFR

SEQ ID NO: 38342 - protein, 8 aa, Artificial Sequence
  Peptide Derived from Human Papillomavirus
VSRTSIFY

SEQ ID NO: 38343 - protein, 9 aa, Artificial Sequence
  Peptide Derived from Human Papillomavirus
VSRTSIFYH

SEQ ID NO: 38344 - protein, 10 aa, Artificial Sequence
  Peptide Derived from Human Papillomavirus
VSRTSIFYHA

SEQ ID NO: 38345 - protein, 8 aa, Artificial Sequence
  Peptide Derived from Human Papillomavirus
VTVVDTTR

SEQ ID NO: 38346 - protein, 10 aa, Artificial Sequence
  Peptide Derived from Human Papillomavirus
VVNTDDYVSR

SEQ ID NO: 38347 - protein, 9 aa, Artificial Sequence
  Peptide Derived from Human Papillomavirus
VVPSGAGNK

SEQ ID NO: 38348 - protein, 11 aa, Artificial Sequence
  Peptide Derived from Human Papillomavirus
VVPSGAGNKQA

SEQ ID NO: 38349 - protein, 10 aa, Artificial Sequence
  Peptide Derived from Human Papillomavirus
WACVGMEIGR

SEQ ID NO: 38350 - protein, 8 aa, Artificial Sequence
  Peptide Derived from Human Papillomavirus
WAKGTLCK

SEQ ID NO: 38351 - protein, 10 aa, Artificial Sequence
  Peptide Derived from Human Papillomavirus
WAKGTLCKPA

SEQ ID NO: 38352 - protein, 8 aa, Artificial Sequence
  Peptide Derived from Human Papillomavirus
WLHKAQGH

SEQ ID NO: 38353 - protein, 8 aa, Artificial Sequence
  Peptide Derived from Human Papillomavirus
WTVDLKEK

SEQ ID NO: 38354 - protein, 9 aa, Artificial Sequence
  Peptide Derived from Human Papillomavirus
WTVDLKEKF

SEQ ID NO: 38355 - protein, 8 aa, Artificial Sequence
  Peptide Derived from Human Papillomavirus
YDPTKFKH

SEQ ID NO: 38356 - protein, 9 aa, Artificial Sequence
  Peptide Derived from Human Papillomavirus
YDPTKFKHY

SEQ ID NO: 38357 - protein, 11 aa, Artificial Sequence
  Peptide Derived from Human Papillomavirus
YDPTKFKHYSR

SEQ ID NO: 38358 - protein, 9 aa, Artificial Sequence
  Peptide Derived from Human Papillomavirus
YFRVVPSGA

SEQ ID NO: 38359 - protein, 10 aa, Artificial Sequence
  Peptide Derived from Human Papillomavirus
YGDSMFFCLR

SEQ ID NO: 38360 - protein, 11 aa, Artificial Sequence
  Peptide Derived from Human Papillomavirus
YGDSMFFCLRR

SEQ ID NO: 38361 - protein, 8 aa, Artificial Sequence
  Peptide Derived from Human Papillomavirus
YGHGIIIF

SEQ ID NO: 38362 - protein, 10 aa, Artificial Sequence
  Peptide Derived from Human Papillomavirus
YGHGIIIFLK

SEQ ID NO: 38363 - protein, 10 aa, Artificial Sequence
  Peptide Derived from Human Papillomavirus
YIKGTSANMR

SEQ ID NO: 38364 - protein, 8 aa, Artificial Sequence
  Peptide Derived from Human Papillomavirus
YLPPPSVA

SEQ ID NO: 38365 - protein, 9 aa, Artificial Sequence
  Peptide Derived from Human Papillomavirus
YLPPPSVAR

SEQ ID NO: 38366 - protein, 9 aa, Artificial Sequence
  Peptide Derived from Human Papillomavirus
YLQMSADPY

SEQ ID NO: 38367 - protein, 8 aa, Artificial Sequence
  Peptide Derived from Human Papillomavirus
YSRHVEEY

SEQ ID NO: 38368 - protein, 8 aa, Artificial Sequence
  Peptide Derived from Human Papillomavirus
YVSRTSIF

SEQ ID NO: 38369 - protein, 9 aa, Artificial Sequence
  Peptide Derived from Human Papillomavirus
YVSRTSIFY

SEQ ID NO: 38370 - protein, 10 aa, Artificial Sequence
  Peptide Derived from Human Papillomavirus
YVSRTSIFYH

SEQ ID NO: 38371 - protein, 11 aa, Artificial Sequence
  Peptide Derived from Human Papillomavirus
YVSRTSIFYHA

SEQ ID NO: 38372 - protein, 9 aa, Artificial Sequence
  Peptide Derived from Human Papillomavirus
AARRKRASA

SEQ ID NO: 38373 - protein, 10 aa, Artificial Sequence
  Peptide Derived from Human Papillomavirus
ALSSRRGTVR

SEQ ID NO: 38374 - protein, 11 aa, Artificial Sequence
  Peptide Derived from Human Papillomavirus
ALSSRRGTVRF

SEQ ID NO: 38375 - protein, 8 aa, Artificial Sequence
  Peptide Derived from Human Papillomavirus
ASATDLYR

SEQ ID NO: 38376 - protein, 11 aa, Artificial Sequence
  Peptide Derived from Human Papillomavirus
ASATDLYRTCK

SEQ ID NO: 38377 - protein, 9 aa, Artificial Sequence
  Peptide Derived from Human Papillomavirus
ASGAPVPTF

SEQ ID NO: 38378 - protein, 9 aa, Artificial Sequence
  Peptide Derived from Human Papillomavirus
ASTTPSTIH

SEQ ID NO: 38379 - protein, 10 aa, Artificial Sequence
  Peptide Derived from Human Papillomavirus
ASTTPSTIHK

SEQ ID NO: 38380 - protein, 10 aa, Artificial Sequence
  Peptide Derived from Human Papillomavirus
ASTTTYIGIH

SEQ ID NO: 38381 - protein, 9 aa, Artificial Sequence
  Peptide Derived from Human Papillomavirus
ATDLYRTCK

SEQ ID NO: 38382 - protein, 9 aa, Artificial Sequence
  Peptide Derived from Human Papillomavirus
ATMFTRSGK

SEQ ID NO: 38383 - protein, 8 aa, Artificial Sequence
  Peptide Derived from Human Papillomavirus
ATNDSDLF

SEQ ID NO: 38384 - protein, 11 aa, Artificial Sequence
  Peptide Derived from Human Papillomavirus
ATNDSDLFDVY

SEQ ID NO: 38385 - protein, 9 aa, Artificial Sequence
  Peptide Derived from Human Papillomavirus
DFMDIIRLH

SEQ ID NO: 38386 - protein, 10 aa, Artificial Sequence
  Peptide Derived from Human Papillomavirus
DFMDIIRLHR

SEQ ID NO: 38387 - protein, 9 aa, Artificial Sequence
  Peptide Derived from Human Papillomavirus
DIIRLHRPA

SEQ ID NO: 38388 - protein, 9 aa, Artificial Sequence
  Peptide Derived from Human Papillomavirus
DLFDVYADF

SEQ ID NO: 38389 - protein, 9 aa, Artificial Sequence
  Peptide Derived from Human Papillomavirus
DSDFMDIIR

SEQ ID NO: 38390 - protein, 11 aa, Artificial Sequence
  Peptide Derived from Human Papillomavirus
DSDFMDIIRLH

SEQ ID NO: 38391 - protein, 8 aa, Artificial Sequence
  Peptide Derived from Human Papillomavirus
DSDLFDVY

SEQ ID NO: 38392 - protein, 9 aa, Artificial Sequence
  Peptide Derived from Human Papillomavirus
DSDLFDVYA

SEQ ID NO: 38393 - protein, 11 aa, Artificial Sequence
  Peptide Derived from Human Papillomavirus
DSDLFDVYADF

SEQ ID NO: 38394 - protein, 9 aa, Artificial Sequence
  Peptide Derived from Human Papillomavirus
DSSVVASGA

SEQ ID NO: 38395 - protein, 10 aa, Artificial Sequence
  Peptide Derived from Human Papillomavirus
DSVSISSTSF

SEQ ID NO: 38396 - protein, 10 aa, Artificial Sequence
  Peptide Derived from Human Papillomavirus
DVYADFPPPA

SEQ ID NO: 38397 - protein, 10 aa, Artificial Sequence
  Peptide Derived from Human Papillomavirus
EDSSVVASGA

SEQ ID NO: 38398 - protein, 8 aa, Artificial Sequence
  Peptide Derived from Human Papillomavirus
EGTTLADK

SEQ ID NO: 38399 - protein, 10 aa, Artificial Sequence
  Peptide Derived from Human Papillomavirus
EIELQPLISA

SEQ ID NO: 38400 - protein, 8 aa, Artificial Sequence
  Peptide Derived from Human Papillomavirus
EIPLQTFA

SEQ ID NO: 38401 - protein, 11 aa, Artificial Sequence
  Peptide Derived from Human Papillomavirus
EITSSGTTTPA

SEQ ID NO: 38402 - protein, 8 aa, Artificial Sequence
  Peptide Derived from Human Papillomavirus
ELQPLISA

SEQ ID NO: 38403 - protein, 8 aa, Artificial Sequence
  Peptide Derived from Human Papillomavirus
FADGFVAA

SEQ ID NO: 38404 - protein, 11 aa, Artificial Sequence
  Peptide Derived from Human Papillomavirus
FDVYADFPPPA

SEQ ID NO: 38405 - protein, 8 aa, Artificial Sequence
  Peptide Derived from Human Papillomavirus
FFADGFVA

SEQ ID NO: 38406 - protein, 9 aa, Artificial Sequence
  Peptide Derived from Human Papillomavirus
FFADGFVAA

SEQ ID NO: 38407 - protein, 11 aa, Artificial Sequence
  Peptide Derived from Human Papillomavirus
FLTHPSSLVTF

SEQ ID NO: 38408 - protein, 8 aa, Artificial Sequence
  Peptide Derived from Human Papillomavirus
FMDIIRLH

SEQ ID NO: 38409 - protein, 9 aa, Artificial Sequence
  Peptide Derived from Human Papillomavirus
FMDIIRLHR

SEQ ID NO: 38410 - protein, 11 aa, Artificial Sequence
  Peptide Derived from Human Papillomavirus
FMDIIRLHRPA

SEQ ID NO: 38411 - protein, 8 aa, Artificial Sequence
  Peptide Derived from Human Papillomavirus
FSRLGQRA

SEQ ID NO: 38412 - protein, 11 aa, Artificial Sequence
  Peptide Derived from Human Papillomavirus
FSRLGQRATMF

SEQ ID NO: 38413 - protein, 11 aa, Artificial Sequence
  Peptide Derived from Human Papillomavirus
FTRSGKQIGGR

SEQ ID NO: 38414 - protein, 10 aa, Artificial Sequence
  Peptide Derived from Human Papillomavirus
FVGTPTSGSH

SEQ ID NO: 38415 - protein, 8 aa, Artificial Sequence
  Peptide Derived from Human Papillomavirus
GGRVHFYH

SEQ ID NO: 38416 - protein, 11 aa, Artificial Sequence
  Peptide Derived from Human Papillomavirus
GIGTGSGSGGR

SEQ ID NO: 38417 - protein, 8 aa, Artificial Sequence
  Peptide Derived from Human Papillomavirus
GIHGTQYY

SEQ ID NO: 38418 - protein, 8 aa, Artificial Sequence
  Peptide Derived from Human Papillomavirus
GSGGRTGY

SEQ ID NO: 38419 - protein, 10 aa, Artificial Sequence
  Peptide Derived from Human Papillomavirus
GSGSGGRTGY

SEQ ID NO: 38420 - protein, 10 aa, Artificial Sequence
  Peptide Derived from Human Papillomavirus
GTCPPDVINK

SEQ ID NO: 38421 - protein, 9 aa, Artificial Sequence
  Peptide Derived from Human Papillomavirus
GTGSGSGGR

SEQ ID NO: 38422 - protein, 8 aa, Artificial Sequence
  Peptide Derived from Human Papillomavirus
GTPTSGSH

SEQ ID NO: 38423 - protein, 10 aa, Artificial Sequence
  Peptide Derived from Human Papillomavirus
GTPTSGSHGY

SEQ ID NO: 38424 - protein, 10 aa, Artificial Sequence
  Peptide Derived from Human Papillomavirus
GTQYYLWPWY

SEQ ID NO: 38425 - protein, 11 aa, Artificial Sequence
  Peptide Derived from Human Papillomavirus
GTQYYLWPWYY

SEQ ID NO: 38426 - protein, 11 aa, Artificial Sequence
  Peptide Derived from Human Papillomavirus
GTVRFSRLGQR

SEQ ID NO: 38427 - protein, 8 aa, Artificial Sequence
  Peptide Derived from Human Papillomavirus
HDISPIAA

SEQ ID NO: 38428 - protein, 10 aa, Artificial Sequence
  Peptide Derived from Human Papillomavirus
HFYHDISPIA

SEQ ID NO: 38429 - protein, 11 aa, Artificial Sequence
  Peptide Derived from Human Papillomavirus
HFYHDISPIAA

SEQ ID NO: 38430 - protein, 11 aa, Artificial Sequence
  Peptide Derived from Human Papillomavirus
HGTQYYLWPWY

SEQ ID NO: 38431 - protein, 11 aa, Artificial Sequence
  Peptide Derived from Human Papillomavirus
HGYEEIPLQTF

SEQ ID NO: 38432 - protein, 11 aa, Artificial Sequence
  Peptide Derived from Human Papillomavirus
IFVGTPTSGSH

SEQ ID NO: 38433 - protein, 8 aa, Artificial Sequence
  Peptide Derived from Human Papillomavirus
IGGRVHFY

SEQ ID NO: 38434 - protein, 9 aa, Artificial Sequence
  Peptide Derived from Human Papillomavirus
IGGRVHFYH

SEQ ID NO: 38435 - protein, 8 aa, Artificial Sequence
  Peptide Derived from Human Papillomavirus
IGIHGTQY

SEQ ID NO: 38436 - protein, 9 aa, Artificial Sequence
  Peptide Derived from Human Papillomavirus
IGIHGTQYY

SEQ ID NO: 38437 - protein, 10 aa, Artificial Sequence
  Peptide Derived from Human Papillomavirus
IGTGSGSGGR

SEQ ID NO: 38438 - protein, 8 aa, Artificial Sequence
  Peptide Derived from Human Papillomavirus
IIRLHRPA

SEQ ID NO: 38439 - protein, 10 aa, Artificial Sequence
  Peptide Derived from Human Papillomavirus
ILQWSSLGIF

SEQ ID NO: 38440 - protein, 10 aa, Artificial Sequence
  Peptide Derived from Human Papillomavirus
ISATNDSDLF

SEQ ID NO: 38441 - protein, 10 aa, Artificial Sequence
  Peptide Derived from Human Papillomavirus
ISSTPLPTVR

SEQ ID NO: 38442 - protein, 11 aa, Artificial Sequence
  Peptide Derived from Human Papillomavirus
ISSTPLPTVRR

SEQ ID NO: 38443 - protein, 10 aa, Artificial Sequence
  Peptide Derived from Human Papillomavirus
ISSTSFTNPA

SEQ ID NO: 38444 - protein, 11 aa, Artificial Sequence
  Peptide Derived from Human Papillomavirus
ISSTSFTNPAF

SEQ ID NO: 38445 - protein, 10 aa, Artificial Sequence
  Peptide Derived from Human Papillomavirus
ITSSGTTTPA

SEQ ID NO: 38446 - protein, 11 aa, Artificial Sequence
  Peptide Derived from Human Papillomavirus
KILQWSSLGIF

SEQ ID NO: 38447 - protein, 8 aa, Artificial Sequence
  Peptide Derived from Human Papillomavirus
KSFTYPKY

SEQ ID NO: 38448 - protein, 8 aa, Artificial Sequence
  Peptide Derived from Human Papillomavirus
KVEGTTLA

SEQ ID NO: 38449 - protein, 10 aa, Artificial Sequence
  Peptide Derived from Human Papillomavirus
KVEGTTLADK

SEQ ID NO: 38450 - protein, 8 aa, Artificial Sequence
  Peptide Derived from Human Papillomavirus
LFDVYADF

SEQ ID NO: 38451 - protein, 8 aa, Artificial Sequence
  Peptide Derived from Human Papillomavirus
LGQRATMF

SEQ ID NO: 38452 - protein, 10 aa, Artificial Sequence
  Peptide Derived from Human Papillomavirus
LGQRATMFTR

SEQ ID NO: 38453 - protein, 11 aa, Artificial Sequence
  Peptide Derived from Human Papillomavirus
LISATNDSDLF

SEQ ID NO: 38454 - protein, 9 aa, Artificial Sequence
  Peptide Derived from Human Papillomavirus
LSSRRGTVR

SEQ ID NO: 38455 - protein, 10 aa, Artificial Sequence
  Peptide Derived from Human Papillomavirus
LSSRRGTVRF

SEQ ID NO: 38456 - protein, 10 aa, Artificial Sequence
  Peptide Derived from Human Papillomavirus
LTHPSSLVTF

SEQ ID NO: 38457 - protein, 8 aa, Artificial Sequence
  Peptide Derived from Human Papillomavirus
LTMPSTAA

SEQ ID NO: 38458 - protein, 11 aa, Artificial Sequence
  Peptide Derived from Human Papillomavirus
LTMPSTAASSY

SEQ ID NO: 38459 - protein, 10 aa, Artificial Sequence
  Peptide Derived from Human Papillomavirus
LTSAWDVPIY

SEQ ID NO: 38460 - protein, 9 aa, Artificial Sequence
  Peptide Derived from Human Papillomavirus
LVEDSSVVA

SEQ ID NO: 38461 - protein, 8 aa, Artificial Sequence
  Peptide Derived from Human Papillomavirus
LVTFDNPA

SEQ ID NO: 38462 - protein, 9 aa, Artificial Sequence
  Peptide Derived from Human Papillomavirus
LVTFDNPAY

SEQ ID NO: 38463 - protein, 8 aa, Artificial Sequence
  Peptide Derived from Human Papillomavirus
MDIIRLHR

SEQ ID NO: 38464 - protein, 10 aa, Artificial Sequence
  Peptide Derived from Human Papillomavirus
MDIIRLHRPA

SEQ ID NO: 38465 - protein, 8 aa, Artificial Sequence
  Peptide Derived from Human Papillomavirus
MVSHRAAR

SEQ ID NO: 38466 - protein, 9 aa, Artificial Sequence
  Peptide Derived from Human Papillomavirus
MVSHRAARR

SEQ ID NO: 38467 - protein, 10 aa, Artificial Sequence
  Peptide Derived from Human Papillomavirus
MVSHRAARRK

SEQ ID NO: 38468 - protein, 11 aa, Artificial Sequence
  Peptide Derived from Human Papillomavirus
MVSHRAARRKR

SEQ ID NO: 38469 - protein, 11 aa, Artificial Sequence
  Peptide Derived from Human Papillomavirus
NASTTTYIGIH

SEQ ID NO: 38470 - protein, 9 aa, Artificial Sequence
  Peptide Derived from Human Papillomavirus
NDSDLFDVY

SEQ ID NO: 38471 - protein, 10 aa, Artificial Sequence
  Peptide Derived from Human Papillomavirus
NDSDLFDVYA

SEQ ID NO: 38472 - protein, 10 aa, Artificial Sequence
  Peptide Derived from Human Papillomavirus
NTVVDVGPTR

SEQ ID NO: 38473 - protein, 9 aa, Artificial Sequence
  Peptide Derived from Human Papillomavirus
NVTVPLTSA

SEQ ID NO: 38474 - protein, 11 aa, Artificial Sequence
  Peptide Derived from Human Papillomavirus
PALSSRRGTVR

SEQ ID NO: 38475 - protein, 10 aa, Artificial Sequence
  Peptide Derived from Human Papillomavirus
PASTTPSTIH

SEQ ID NO: 38476 - protein, 11 aa, Artificial Sequence
  Peptide Derived from Human Papillomavirus
PASTTPSTIHK

SEQ ID NO: 38477 - protein, 8 aa, Artificial Sequence
  Peptide Derived from Human Papillomavirus
PDIILPSH

SEQ ID NO: 38478 - protein, 10 aa, Artificial Sequence
  Peptide Derived from Human Papillomavirus
PDSDFMDIIR

SEQ ID NO: 38479 - protein, 11 aa, Artificial Sequence
  Peptide Derived from Human Papillomavirus
PISSTPLPTVR

SEQ ID NO: 38480 - protein, 8 aa, Artificial Sequence
  Peptide Derived from Human Papillomavirus
PLDTTLSF

SEQ ID NO: 38481 - protein, 9 aa, Artificial Sequence
  Peptide Derived from Human Papillomavirus
PLPTVRRVR

SEQ ID NO: 38482 - protein, 11 aa, Artificial Sequence
  Peptide Derived from Human Papillomavirus
PLTSAWDVPIY

SEQ ID NO: 38483 - protein, 11 aa, Artificial Sequence
  Peptide Derived from Human Papillomavirus
PMWPSTSPTNA

SEQ ID NO: 38484 - protein, 11 aa, Artificial Sequence
  Peptide Derived from Human Papillomavirus
PSSLVTFDNPA

SEQ ID NO: 38485 - protein, 8 aa, Artificial Sequence
  Peptide Derived from Human Papillomavirus
PSTAASSY

SEQ ID NO: 38486 - protein, 8 aa, Artificial Sequence
  Peptide Derived from Human Papillomavirus
PSTIHKSF

SEQ ID NO: 38487 - protein, 10 aa, Artificial Sequence
  Peptide Derived from Human Papillomavirus
PSTIHKSFTY

SEQ ID NO: 38488 - protein, 8 aa, Artificial Sequence
  Peptide Derived from Human Papillomavirus
PSTSPTNA

SEQ ID NO: 38489 - protein, 9 aa, Artificial Sequence
  Peptide Derived from Human Papillomavirus
PTFTGTSGF

SEQ ID NO: 38490 - protein, 9 aa, Artificial Sequence
  Peptide Derived from Human Papillomavirus
PTNASTTTY

SEQ ID NO: 38491 - protein, 8 aa, Artificial Sequence
  Peptide Derived from Human Papillomavirus
PTSGSHGY

SEQ ID NO: 38492 - protein, 10 aa, Artificial Sequence
  Peptide Derived from Human Papillomavirus
PTSNVPDSDF

SEQ ID NO: 38493 - protein, 10 aa, Artificial Sequence
  Peptide Derived from Human Papillomavirus
PTVRRVRGPR

SEQ ID NO: 38494 - protein, 11 aa, Artificial Sequence
  Peptide Derived from Human Papillomavirus
PVPTFTGTSGF

SEQ ID NO: 38495 - protein, 8 aa, Artificial Sequence
  Peptide Derived from Human Papillomavirus
QIGGRVHF

SEQ ID NO: 38496 - protein, 9 aa, Artificial Sequence
  Peptide Derived from Human Papillomavirus
QIGGRVHFY

SEQ ID NO: 38497 - protein, 10 aa, Artificial Sequence
  Peptide Derived from Human Papillomavirus
QIGGRVHFYH

SEQ ID NO: 38498 - protein, 10 aa, Artificial Sequence
  Peptide Derived from Human Papillomavirus
QTGEVSGNIF

SEQ ID NO: 38499 - protein, 9 aa, Artificial Sequence
  Peptide Derived from Human Papillomavirus
QVRVSTSQF

SEQ ID NO: 38500 - protein, 8 aa, Artificial Sequence
  Peptide Derived from Human Papillomavirus
RAARRKRA

SEQ ID NO: 38501 - protein, 10 aa, Artificial Sequence
  Peptide Derived from Human Papillomavirus
RAARRKRASA

SEQ ID NO: 38502 - protein, 8 aa, Artificial Sequence
  Peptide Derived from Human Papillomavirus
RASATDLY

SEQ ID NO: 38503 - protein, 9 aa, Artificial Sequence
  Peptide Derived from Human Papillomavirus
RASATDLYR

SEQ ID NO: 38504 - protein, 10 aa, Artificial Sequence
  Peptide Derived from Human Papillomavirus
RATMFTRSGK

SEQ ID NO: 38505 - protein, 8 aa, Artificial Sequence
  Peptide Derived from Human Papillomavirus
RFSRLGQR

SEQ ID NO: 38506 - protein, 9 aa, Artificial Sequence
  Peptide Derived from Human Papillomavirus
RFSRLGQRA

SEQ ID NO: 38507 - protein, 8 aa, Artificial Sequence
  Peptide Derived from Human Papillomavirus
RGPRLYSR

SEQ ID NO: 38508 - protein, 9 aa, Artificial Sequence
  Peptide Derived from Human Papillomavirus
RGPRLYSRA

SEQ ID NO: 38509 - protein, 8 aa, Artificial Sequence
  Peptide Derived from Human Papillomavirus
RGTVRFSR

SEQ ID NO: 38510 - protein, 10 aa, Artificial Sequence
  Peptide Derived from Human Papillomavirus
RIPYFFADGF

SEQ ID NO: 38511 - protein, 9 aa, Artificial Sequence
  Peptide Derived from Human Papillomavirus
RLGQRATMF

SEQ ID NO: 38512 - protein, 11 aa, Artificial Sequence
  Peptide Derived from Human Papillomavirus
RLGQRATMFTR

SEQ ID NO: 38513 - protein, 10 aa, Artificial Sequence
  Peptide Derived from Human Papillomavirus
RLHRPALSSR

SEQ ID NO: 38514 - protein, 11 aa, Artificial Sequence
  Peptide Derived from Human Papillomavirus
RLHRPALSSRR

SEQ ID NO: 38515 - protein, 11 aa, Artificial Sequence
  Peptide Derived from Human Papillomavirus
RLYSRANQQVR

SEQ ID NO: 38516 - protein, 9 aa, Artificial Sequence
  Peptide Derived from Human Papillomavirus
RSGKQIGGR

SEQ ID NO: 38517 - protein, 11 aa, Artificial Sequence
  Peptide Derived from Human Papillomavirus
RSGKQIGGRVH

SEQ ID NO: 38518 - protein, 10 aa, Artificial Sequence
  Peptide Derived from Human Papillomavirus
RTGYVPLGGR

SEQ ID NO: 38519 - protein, 8 aa, Artificial Sequence
  Peptide Derived from Human Papillomavirus
RVRGPRLY

SEQ ID NO: 38520 - protein, 10 aa, Artificial Sequence
  Peptide Derived from Human Papillomavirus
RVRGPRLYSR

SEQ ID NO: 38521 - protein, 11 aa, Artificial Sequence
  Peptide Derived from Human Papillomavirus
RVRGPRLYSRA

SEQ ID NO: 38522 - protein, 10 aa, Artificial Sequence
  Peptide Derived from Human Papillomavirus
RVSTSQFLTH

SEQ ID NO: 38523 - protein, 10 aa, Artificial Sequence
  Peptide Derived from Human Papillomavirus
SATDLYRTCK

SEQ ID NO: 38524 - protein, 9 aa, Artificial Sequence
  Peptide Derived from Human Papillomavirus
SATNDSDLF

SEQ ID NO: 38525 - protein, 8 aa, Artificial Sequence
  Peptide Derived from Human Papillomavirus
SAWDVPIY

SEQ ID NO: 38526 - protein, 8 aa, Artificial Sequence
  Peptide Derived from Human Papillomavirus
SDFMDIIR

SEQ ID NO: 38527 - protein, 10 aa, Artificial Sequence
  Peptide Derived from Human Papillomavirus
SDFMDIIRLH

SEQ ID NO: 38528 - protein, 11 aa, Artificial Sequence
  Peptide Derived from Human Papillomavirus
SDFMDIIRLHR

SEQ ID NO: 38529 - protein, 8 aa, Artificial Sequence
  Peptide Derived from Human Papillomavirus
SDLFDVYA

SEQ ID NO: 38530 - protein, 10 aa, Artificial Sequence
  Peptide Derived from Human Papillomavirus
SDLFDVYADF

SEQ ID NO: 38531 - protein, 8 aa, Artificial Sequence
  Peptide Derived from Human Papillomavirus
SGAPVPTF

SEQ ID NO: 38532 - protein, 8 aa, Artificial Sequence
  Peptide Derived from Human Papillomavirus
SGKQIGGR

SEQ ID NO: 38533 - protein, 10 aa, Artificial Sequence
  Peptide Derived from Human Papillomavirus
SGKQIGGRVH

SEQ ID NO: 38534 - protein, 11 aa, Artificial Sequence
  Peptide Derived from Human Papillomavirus
SGKQIGGRVHF

SEQ ID NO: 38535 - protein, 9 aa, Artificial Sequence
  Peptide Derived from Human Papillomavirus
SGSGGRTGY

SEQ ID NO: 38536 - protein, 11 aa, Artificial Sequence
  Peptide Derived from Human Papillomavirus
SGTCPPDVINK

SEQ ID NO: 38537 - protein, 11 aa, Artificial Sequence
  Peptide Derived from Human Papillomavirus
SISSTSFTNPA

SEQ ID NO: 38538 - protein, 8 aa, Artificial Sequence
  Peptide Derived from Human Papillomavirus
SLTMPSTA

SEQ ID NO: 38539 - protein, 9 aa, Artificial Sequence
  Peptide Derived from Human Papillomavirus
SLTMPSTAA

SEQ ID NO: 38540 - protein, 9 aa, Artificial Sequence
  Peptide Derived from Human Papillomavirus
SLVTFDNPA

SEQ ID NO: 38541 - protein, 10 aa, Artificial Sequence
  Peptide Derived from Human Papillomavirus
SLVTFDNPAY

SEQ ID NO: 38542 - protein, 8 aa, Artificial Sequence
  Peptide Derived from Human Papillomavirus
SSGTTTPA

SEQ ID NO: 38543 - protein, 10 aa, Artificial Sequence
  Peptide Derived from Human Papillomavirus
SSLVTFDNPA

SEQ ID NO: 38544 - protein, 11 aa, Artificial Sequence
  Peptide Derived from Human Papillomavirus
SSLVTFDNPAY

SEQ ID NO: 38545 - protein, 8 aa, Artificial Sequence
  Peptide Derived from Human Papillomavirus
SSRRGTVR

SEQ ID NO: 38546 - protein, 9 aa, Artificial Sequence
  Peptide Derived from Human Papillomavirus
SSRRGTVRF

SEQ ID NO: 38547 - protein, 11 aa, Artificial Sequence
  Peptide Derived from Human Papillomavirus
SSRRGTVRFSR

SEQ ID NO: 38548 - protein, 9 aa, Artificial Sequence
  Peptide Derived from Human Papillomavirus
SSTPLPTVR

SEQ ID NO: 38549 - protein, 10 aa, Artificial Sequence
  Peptide Derived from Human Papillomavirus
SSTPLPTVRR

SEQ ID NO: 38550 - protein, 9 aa, Artificial Sequence
  Peptide Derived from Human Papillomavirus
SSTSFTNPA

SEQ ID NO: 38551 - protein, 10 aa, Artificial Sequence
  Peptide Derived from Human Papillomavirus
SSTSFTNPAF

SEQ ID NO: 38552 - protein, 8 aa, Artificial Sequence
  Peptide Derived from Human Papillomavirus
SSVVASGA

SEQ ID NO: 38553 - protein, 9 aa, Artificial Sequence
  Peptide Derived from Human Papillomavirus
STIHKSFTY

SEQ ID NO: 38554 - protein, 11 aa, Artificial Sequence
  Peptide Derived from Human Papillomavirus
STIHKSFTYPK

SEQ ID NO: 38555 - protein, 8 aa, Artificial Sequence
  Peptide Derived from Human Papillomavirus
STPLPTVR

SEQ ID NO: 38556 - protein, 9 aa, Artificial Sequence
  Peptide Derived from Human Papillomavirus
STPLPTVRR

SEQ ID NO: 38557 - protein, 11 aa, Artificial Sequence
  Peptide Derived from Human Papillomavirus
STPLPTVRRVR

SEQ ID NO: 38558 - protein, 8 aa, Artificial Sequence
  Peptide Derived from Human Papillomavirus
STSFTNPA

SEQ ID NO: 38559 - protein, 9 aa, Artificial Sequence
  Peptide Derived from Human Papillomavirus
STSFTNPAF

SEQ ID NO: 38560 - protein, 8 aa, Artificial Sequence
  Peptide Derived from Human Papillomavirus
STSQFLTH

SEQ ID NO: 38561 - protein, 8 aa, Artificial Sequence
  Peptide Derived from Human Papillomavirus
STTPSTIH

SEQ ID NO: 38562 - protein, 9 aa, Artificial Sequence
  Peptide Derived from Human Papillomavirus
STTPSTIHK

SEQ ID NO: 38563 - protein, 11 aa, Artificial Sequence
  Peptide Derived from Human Papillomavirus
STTPSTIHKSF

SEQ ID NO: 38564 - protein, 9 aa, Artificial Sequence
  Peptide Derived from Human Papillomavirus
STTTYIGIH

SEQ ID NO: 38565 - protein, 9 aa, Artificial Sequence
  Peptide Derived from Human Papillomavirus
SVSISSTSF

SEQ ID NO: 38566 - protein, 9 aa, Artificial Sequence
  Peptide Derived from Human Papillomavirus
TCPPDVINK

SEQ ID NO: 38567 - protein, 8 aa, Artificial Sequence
  Peptide Derived from Human Papillomavirus
TDLYRTCK

SEQ ID NO: 38568 - protein, 8 aa, Artificial Sequence
  Peptide Derived from Human Papillomavirus
TFTGTSGF

SEQ ID NO: 38569 - protein, 9 aa, Artificial Sequence
  Peptide Derived from Human Papillomavirus
TGEVSGNIF

SEQ ID NO: 38570 - protein, 10 aa, Artificial Sequence
  Peptide Derived from Human Papillomavirus
TGPDIILPSH

SEQ ID NO: 38571 - protein, 8 aa, Artificial Sequence
  Peptide Derived from Human Papillomavirus
TGSGSGGR

SEQ ID NO: 38572 - protein, 11 aa, Artificial Sequence
  Peptide Derived from Human Papillomavirus
TGSGSGGRTGY

SEQ ID NO: 38573 - protein, 9 aa, Artificial Sequence
  Peptide Derived from Human Papillomavirus
TGYVPLGGR

SEQ ID NO: 38574 - protein, 8 aa, Artificial Sequence
  Peptide Derived from Human Papillomavirus
TIHKSFTY

SEQ ID NO: 38575 - protein, 10 aa, Artificial Sequence
  Peptide Derived from Human Papillomavirus
TIHKSFTYPK

SEQ ID NO: 38576 - protein, 11 aa, Artificial Sequence
  Peptide Derived from Human Papillomavirus
TIHKSFTYPKY

SEQ ID NO: 38577 - protein, 10 aa, Artificial Sequence
  Peptide Derived from Human Papillomavirus
TLVEDSSVVA

SEQ ID NO: 38578 - protein, 8 aa, Artificial Sequence
  Peptide Derived from Human Papillomavirus
TMFTRSGK

SEQ ID NO: 38579 - protein, 10 aa, Artificial Sequence
  Peptide Derived from Human Papillomavirus
TMPSTAASSY

SEQ ID NO: 38580 - protein, 9 aa, Artificial Sequence
  Peptide Derived from Human Papillomavirus
TSAWDVPIY

SEQ ID NO: 38581 - protein, 8 aa, Artificial Sequence
  Peptide Derived from Human Papillomavirus
TSFTNPAF

SEQ ID NO: 38582 - protein, 9 aa, Artificial Sequence
  Peptide Derived from Human Papillomavirus
TSNVPDSDF

SEQ ID NO: 38583 - protein, 11 aa, Artificial Sequence
  Peptide Derived from Human Papillomavirus
TSPTNASTTTY

SEQ ID NO: 38584 - protein, 9 aa, Artificial Sequence
  Peptide Derived from Human Papillomavirus
TSSGTTTPA

SEQ ID NO: 38585 - protein, 8 aa, Artificial Sequence
  Peptide Derived from Human Papillomavirus
TTPSTIHK

SEQ ID NO: 38586 - protein, 10 aa, Artificial Sequence
  Peptide Derived from Human Papillomavirus
TTPSTIHKSF

SEQ ID NO: 38587 - protein, 8 aa, Artificial Sequence
  Peptide Derived from Human Papillomavirus
TTTYIGIH

SEQ ID NO: 38588 - protein, 11 aa, Artificial Sequence
  Peptide Derived from Human Papillomavirus
TTYIGIHGTQY

SEQ ID NO: 38589 - protein, 10 aa, Artificial Sequence
  Peptide Derived from Human Papillomavirus
TVRFSRLGQR

SEQ ID NO: 38590 - protein, 11 aa, Artificial Sequence
  Peptide Derived from Human Papillomavirus
TVRFSRLGQRA

SEQ ID NO: 38591 - protein, 9 aa, Artificial Sequence
  Peptide Derived from Human Papillomavirus
TVRRVRGPR

SEQ ID NO: 38592 - protein, 11 aa, Artificial Sequence
  Peptide Derived from Human Papillomavirus
TVRRVRGPRLY

SEQ ID NO: 38593 - protein, 9 aa, Artificial Sequence
  Peptide Derived from Human Papillomavirus
TVVDVGPTR

SEQ ID NO: 38594 - protein, 10 aa, Artificial Sequence
  Peptide Derived from Human Papillomavirus
VASGAPVPTF

SEQ ID NO: 38595 - protein, 11 aa, Artificial Sequence
  Peptide Derived from Human Papillomavirus
VDSVSISSTSF

SEQ ID NO: 38596 - protein, 9 aa, Artificial Sequence
  Peptide Derived from Human Papillomavirus
VGTPTSGSH

SEQ ID NO: 38597 - protein, 11 aa, Artificial Sequence
  Peptide Derived from Human Papillomavirus
VGTPTSGSHGY

SEQ ID NO: 38598 - protein, 11 aa, Artificial Sequence
  Peptide Derived from Human Papillomavirus
VINKVEGTTLA

SEQ ID NO: 38599 - protein, 8 aa, Artificial Sequence
  Peptide Derived from Human Papillomavirus
VSHRAARR

SEQ ID NO: 38600 - protein, 9 aa, Artificial Sequence
  Peptide Derived from Human Papillomavirus
VSHRAARRK

SEQ ID NO: 38601 - protein, 10 aa, Artificial Sequence
  Peptide Derived from Human Papillomavirus
VSHRAARRKR

SEQ ID NO: 38602 - protein, 11 aa, Artificial Sequence
  Peptide Derived from Human Papillomavirus
VSHRAARRKRA

SEQ ID NO: 38603 - protein, 8 aa, Artificial Sequence
  Peptide Derived from Human Papillomavirus
VSISSTSF

SEQ ID NO: 38604 - protein, 9 aa, Artificial Sequence
  Peptide Derived from Human Papillomavirus
VSTSQFLTH

SEQ ID NO: 38605 - protein, 8 aa, Artificial Sequence
  Peptide Derived from Human Papillomavirus
VTFDNPAY

SEQ ID NO: 38606 - protein, 11 aa, Artificial Sequence
  Peptide Derived from Human Papillomavirus
VTLVEDSSVVA

SEQ ID NO: 38607 - protein, 8 aa, Artificial Sequence
  Peptide Derived from Human Papillomavirus
VTVPLTSA

SEQ ID NO: 38608 - protein, 11 aa, Artificial Sequence
  Peptide Derived from Human Papillomavirus
VVASGAPVPTF

SEQ ID NO: 38609 - protein, 8 aa, Artificial Sequence
  Peptide Derived from Human Papillomavirus
VVDVGPTR

SEQ ID NO: 38610 - protein, 8 aa, Artificial Sequence
  Peptide Derived from Human Papillomavirus
YADFPPPA

SEQ ID NO: 38611 - protein, 9 aa, Artificial Sequence
  Peptide Derived from Human Papillomavirus
YFFADGFVA

SEQ ID NO: 38612 - protein, 10 aa, Artificial Sequence
  Peptide Derived from Human Papillomavirus
YFFADGFVAA

SEQ ID NO: 38613 - protein, 8 aa, Artificial Sequence
  Peptide Derived from Human Papillomavirus
YFPKKRKR

SEQ ID NO: 38614 - protein, 11 aa, Artificial Sequence
  Peptide Derived from Human Papillomavirus
YFPKKRKRIPY

SEQ ID NO: 38615 - protein, 9 aa, Artificial Sequence
  Peptide Derived from Human Papillomavirus
YIGIHGTQY

SEQ ID NO: 38616 - protein, 10 aa, Artificial Sequence
  Peptide Derived from Human Papillomavirus
YIGIHGTQYY

SEQ ID NO: 38617 - protein, 8 aa, Artificial Sequence
  Peptide Derived from Human Papillomavirus
YLWPWYYY

SEQ ID NO: 38618 - protein, 9 aa, Artificial Sequence
  Peptide Derived from Human Papillomavirus
YLWPWYYYF

SEQ ID NO: 38619 - protein, 11 aa, Artificial Sequence
  Peptide Derived from Human Papillomavirus
YLWPWYYYFPK

SEQ ID NO: 38620 - protein, 9 aa, Artificial Sequence
  Peptide Derived from Human Papillomavirus
YSLTMPSTA

SEQ ID NO: 38621 - protein, 10 aa, Artificial Sequence
  Peptide Derived from Human Papillomavirus
YSLTMPSTAA

SEQ ID NO: 38622 - protein, 11 aa, Artificial Sequence
  Peptide Derived from Human Papillomavirus
YSNVTVPLTSA

SEQ ID NO: 38623 - protein, 9 aa, Artificial Sequence
  Peptide Derived from Human Papillomavirus
YSRANQQVR

SEQ ID NO: 38624 - protein, 11 aa, Artificial Sequence
  Peptide Derived from Human Papillomavirus
YTGPDIILPSH

SEQ ID NO: 38625 - protein, 9 aa, Artificial Sequence
  Peptide Derived from Human Papillomavirus
AAVSHRPGK

SEQ ID NO: 38626 - protein, 10 aa, Artificial Sequence
  Peptide Derived from Human Papillomavirus
AAVSHRPGKR

SEQ ID NO: 38627 - protein, 10 aa, Artificial Sequence
  Peptide Derived from Human Papillomavirus
ACSAIEVQIA

SEQ ID NO: 38628 - protein, 10 aa, Artificial Sequence
  Peptide Derived from Human Papillomavirus
ALESLSTTIY

SEQ ID NO: 38629 - protein, 8 aa, Artificial Sequence
  Peptide Derived from Human Papillomavirus
AVSHRPGK

SEQ ID NO: 38630 - protein, 9 aa, Artificial Sequence
  Peptide Derived from Human Papillomavirus
AVSHRPGKR

SEQ ID NO: 38631 - protein, 11 aa, Artificial Sequence
  Peptide Derived from Human Papillomavirus
AVSHRPGKRPR

SEQ ID NO: 38632 - protein, 8 aa, Artificial Sequence
  Peptide Derived from Human Papillomavirus
CCRYRFQK

SEQ ID NO: 38633 - protein, 9 aa, Artificial Sequence
  Peptide Derived from Human Papillomavirus
CCRYRFQKY

SEQ ID NO: 38634 - protein, 10 aa, Artificial Sequence
  Peptide Derived from Human Papillomavirus
CCRYRFQKYK

SEQ ID NO: 38635 - protein, 8 aa, Artificial Sequence
  Peptide Derived from Human Papillomavirus
CFKKEGQH

SEQ ID NO: 38636 - protein, 8 aa, Artificial Sequence
  Peptide Derived from Human Papillomavirus
CLQVCKAK

SEQ ID NO: 38637 - protein, 9 aa, Artificial Sequence
  Peptide Derived from Human Papillomavirus
CLQVCKAKA

SEQ ID NO: 38638 - protein, 8 aa, Artificial Sequence
  Peptide Derived from Human Papillomavirus
CMQYVAWK

SEQ ID NO: 38639 - protein, 9 aa, Artificial Sequence
  Peptide Derived from Human Papillomavirus
CMQYVAWKY

SEQ ID NO: 38640 - protein, 11 aa, Artificial Sequence
  Peptide Derived from Human Papillomavirus
CMQYVAWKYIY

SEQ ID NO: 38641 - protein, 9 aa, Artificial Sequence
  Peptide Derived from Human Papillomavirus
CSAIEVQIA

SEQ ID NO: 38642 - protein, 10 aa, Artificial Sequence
  Peptide Derived from Human Papillomavirus
CSGVDYRGIY

SEQ ID NO: 38643 - protein, 11 aa, Artificial Sequence
  Peptide Derived from Human Papillomavirus
CSGVDYRGIYY

SEQ ID NO: 38644 - protein, 10 aa, Artificial Sequence
  Peptide Derived from Human Papillomavirus
DAAVSHRPGK

SEQ ID NO: 38645 - protein, 11 aa, Artificial Sequence
  Peptide Derived from Human Papillomavirus
DAAVSHRPGKR

SEQ ID NO: 38646 - protein, 8 aa, Artificial Sequence
  Peptide Derived from Human Papillomavirus
DFEQEAKK

SEQ ID NO: 38647 - protein, 9 aa, Artificial Sequence
  Peptide Derived from Human Papillomavirus
DFEQEAKKF

SEQ ID NO: 38648 - protein, 10 aa, Artificial Sequence
  Peptide Derived from Human Papillomavirus
DGHKTYYTDF

SEQ ID NO: 38649 - protein, 10 aa, Artificial Sequence
  Peptide Derived from Human Papillomavirus
DGSKNNCMQY

SEQ ID NO: 38650 - protein, 8 aa, Artificial Sequence
  Peptide Derived from Human Papillomavirus
DSSRESHA

SEQ ID NO: 38651 - protein, 9 aa, Artificial Sequence
  Peptide Derived from Human Papillomavirus
DSSRESHAK

SEQ ID NO: 38652 - protein, 8 aa, Artificial Sequence
  Peptide Derived from Human Papillomavirus
DSVSSTCR

SEQ ID NO: 38653 - protein, 9 aa, Artificial Sequence
  Peptide Derived from Human Papillomavirus
DSVSSTCRY

SEQ ID NO: 38654 - protein, 8 aa, Artificial Sequence
  Peptide Derived from Human Papillomavirus
DTDNTDSR

SEQ ID NO: 38655 - protein, 10 aa, Artificial Sequence
  Peptide Derived from Human Papillomavirus
DTDNTDSRSR

SEQ ID NO: 38656 - protein, 8 aa, Artificial Sequence
  Peptide Derived from Human Papillomavirus
EAKKFGCK

SEQ ID NO: 38657 - protein, 9 aa, Artificial Sequence
  Peptide Derived from Human Papillomavirus
EFDSSRESH

SEQ ID NO: 38658 - protein, 10 aa, Artificial Sequence
  Peptide Derived from Human Papillomavirus
EFDSSRESHA

SEQ ID NO: 38659 - protein, 11 aa, Artificial Sequence
  Peptide Derived from Human Papillomavirus
EFDSSRESHAK

SEQ ID NO: 38660 - protein, 9 aa, Artificial Sequence
  Peptide Derived from Human Papillomavirus
EGQHIEVWF

SEQ ID NO: 38661 - protein, 8 aa, Artificial Sequence
  Peptide Derived from Human Papillomavirus
ELWLTEPK

SEQ ID NO: 38662 - protein, 9 aa, Artificial Sequence
  Peptide Derived from Human Papillomavirus
ELWLTEPKK

SEQ ID NO: 38663 - protein, 11 aa, Artificial Sequence
  Peptide Derived from Human Papillomavirus
ELWLTEPKKCF

SEQ ID NO: 38664 - protein, 8 aa, Artificial Sequence
  Peptide Derived from Human Papillomavirus
ESEFDSSR

SEQ ID NO: 38665 - protein, 11 aa, Artificial Sequence
  Peptide Derived from Human Papillomavirus
ESEFDSSRESH

SEQ ID NO: 38666 - protein, 10 aa, Artificial Sequence
  Peptide Derived from Human Papillomavirus
ESHAKCVTTH

SEQ ID NO: 38667 - protein, 8 aa, Artificial Sequence
  Peptide Derived from Human Papillomavirus
ESLSTTIY

SEQ ID NO: 38668 - protein, 10 aa, Artificial Sequence
  Peptide Derived from Human Papillomavirus
ETQRNSFLSH

SEQ ID NO: 38669 - protein, 9 aa, Artificial Sequence
  Peptide Derived from Human Papillomavirus
ETVNEYNTH

SEQ ID NO: 38670 - protein, 10 aa, Artificial Sequence
  Peptide Derived from Human Papillomavirus
ETVNEYNTHK

SEQ ID NO: 38671 - protein, 10 aa, Artificial Sequence
  Peptide Derived from Human Papillomavirus
EVHMENESIY

SEQ ID NO: 38672 - protein, 8 aa, Artificial Sequence
  Peptide Derived from Human Papillomavirus
EVWFDGSK

SEQ ID NO: 38673 - protein, 11 aa, Artificial Sequence
  Peptide Derived from Human Papillomavirus
FDGSKNNCMQY

SEQ ID NO: 38674 - protein, 8 aa, Artificial Sequence
  Peptide Derived from Human Papillomavirus
FDSSRESH

SEQ ID NO: 38675 - protein, 9 aa, Artificial Sequence
  Peptide Derived from Human Papillomavirus
FDSSRESHA

SEQ ID NO: 38676 - protein, 10 aa, Artificial Sequence
  Peptide Derived from Human Papillomavirus
FDSSRESHAK

SEQ ID NO: 38677 - protein, 10 aa, Artificial Sequence
  Peptide Derived from Human Papillomavirus
FGCKNIWEVH

SEQ ID NO: 38678 - protein, 11 aa, Artificial Sequence
  Peptide Derived from Human Papillomavirus
FLSHVKIPVVY

SEQ ID NO: 38679 - protein, 8 aa, Artificial Sequence
  Peptide Derived from Human Papillomavirus
FVDVTSTY

SEQ ID NO: 38680 - protein, 9 aa, Artificial Sequence
  Peptide Derived from Human Papillomavirus
FVDVTSTYH

SEQ ID NO: 38681 - protein, 9 aa, Artificial Sequence
  Peptide Derived from Human Papillomavirus
GCKNIWEVH

SEQ ID NO: 38682 - protein, 9 aa, Artificial Sequence
  Peptide Derived from Human Papillomavirus
GDKTTPVVH

SEQ ID NO: 38683 - protein, 11 aa, Artificial Sequence
  Peptide Derived from Human Papillomavirus
GDKTTPVVHLK

SEQ ID NO: 38684 - protein, 9 aa, Artificial Sequence
  Peptide Derived from Human Papillomavirus
GIYYVHDGH

SEQ ID NO: 38685 - protein, 10 aa, Artificial Sequence
  Peptide Derived from Human Papillomavirus
GIYYVHDGHK

SEQ ID NO: 38686 - protein, 9 aa, Artificial Sequence
  Peptide Derived from Human Papillomavirus
GSKNNCMQY

SEQ ID NO: 38687 - protein, 11 aa, Artificial Sequence
  Peptide Derived from Human Papillomavirus
GSKNNCMQYVA

SEQ ID NO: 38688 - protein, 8 aa, Artificial Sequence
  Peptide Derived from Human Papillomavirus
GVDYRGIY

SEQ ID NO: 38689 - protein, 9 aa, Artificial Sequence
  Peptide Derived from Human Papillomavirus
GVDYRGIYY

SEQ ID NO: 38690 - protein, 11 aa, Artificial Sequence
  Peptide Derived from Human Papillomavirus
GVDYRGIYYVH

SEQ ID NO: 38691 - protein, 8 aa, Artificial Sequence
  Peptide Derived from Human Papillomavirus
HAKCVTTH

SEQ ID NO: 38692 - protein, 10 aa, Artificial Sequence
  Peptide Derived from Human Papillomavirus
HAKCVTTHTH

SEQ ID NO: 38693 - protein, 8 aa, Artificial Sequence
  Peptide Derived from Human Papillomavirus
HDGHKTYY

SEQ ID NO: 38694 - protein, 11 aa, Artificial Sequence
  Peptide Derived from Human Papillomavirus
HDGHKTYYTDF

SEQ ID NO: 38695 - protein, 10 aa, Artificial Sequence
  Peptide Derived from Human Papillomavirus
HIEVWFDGSK

SEQ ID NO: 38696 - protein, 11 aa, Artificial Sequence
  Peptide Derived from Human Papillomavirus
HISDTDNTDSR

SEQ ID NO: 38697 - protein, 8 aa, Artificial Sequence
  Peptide Derived from Human Papillomavirus
HLKGEPNR

SEQ ID NO: 38698 - protein, 10 aa, Artificial Sequence
  Peptide Derived from Human Papillomavirus
HLKGEPNRLK

SEQ ID NO: 38699 - protein, 8 aa, Artificial Sequence
  Peptide Derived from Human Papillomavirus
HMENESIY

SEQ ID NO: 38700 - protein, 8 aa, Artificial Sequence
  Peptide Derived from Human Papillomavirus
HVKIPVVY

SEQ ID NO: 38701 - protein, 9 aa, Artificial Sequence
  Peptide Derived from Human Papillomavirus
HVKIPVVYR

SEQ ID NO: 38702 - protein, 11 aa, Artificial Sequence
  Peptide Derived from Human Papillomavirus
IALESLSTTIY

SEQ ID NO: 38703 - protein, 9 aa, Artificial Sequence
  Peptide Derived from Human Papillomavirus
IIYKDETQR

SEQ ID NO: 38704 - protein, 10 aa, Artificial Sequence
  Peptide Derived from Human Papillomavirus
ISDTDNTDSR

SEQ ID NO: 38705 - protein, 11 aa, Artificial Sequence
  Peptide Derived from Human Papillomavirus
ITIIYKDETQR

SEQ ID NO: 38706 - protein, 11 aa, Artificial Sequence
  Peptide Derived from Human Papillomavirus
KACSAIEVQIA

SEQ ID NO: 38707 - protein, 9 aa, Artificial Sequence
  Peptide Derived from Human Papillomavirus
KCCRYRFQK

SEQ ID NO: 38708 - protein, 10 aa, Artificial Sequence
  Peptide Derived from Human Papillomavirus
KCCRYRFQKY

SEQ ID NO: 38709 - protein, 11 aa, Artificial Sequence
  Peptide Derived from Human Papillomavirus
KCCRYRFQKYK

SEQ ID NO: 38710 - protein, 9 aa, Artificial Sequence
  Peptide Derived from Human Papillomavirus
KCFKKEGQH

SEQ ID NO: 38711 - protein, 8 aa, Artificial Sequence
  Peptide Derived from Human Papillomavirus
KCVTTHTH

SEQ ID NO: 38712 - protein, 9 aa, Artificial Sequence
  Peptide Derived from Human Papillomavirus
KDETQRNSF

SEQ ID NO: 38713 - protein, 11 aa, Artificial Sequence
  Peptide Derived from Human Papillomavirus
KFGCKNIWEVH

SEQ ID NO: 38714 - protein, 8 aa, Artificial Sequence
  Peptide Derived from Human Papillomavirus
KGEPNRLK

SEQ ID NO: 38715 - protein, 11 aa, Artificial Sequence
  Peptide Derived from Human Papillomavirus
KGEPNRLKCCR

SEQ ID NO: 38716 - protein, 11 aa, Artificial Sequence
  Peptide Derived from Human Papillomavirus
KTLFVDVTSTY

SEQ ID NO: 38717 - protein, 9 aa, Artificial Sequence
  Peptide Derived from Human Papillomavirus
KTTPVVHLK

SEQ ID NO: 38718 - protein, 11 aa, Artificial Sequence
  Peptide Derived from Human Papillomavirus
KTYYTDFEQEA

SEQ ID NO: 38719 - protein, 8 aa, Artificial Sequence
  Peptide Derived from Human Papillomavirus
KVCSGVDY

SEQ ID NO: 38720 - protein, 9 aa, Artificial Sequence
  Peptide Derived from Human Papillomavirus
KVCSGVDYR

SEQ ID NO: 38721 - protein, 9 aa, Artificial Sequence
  Peptide Derived from Human Papillomavirus
LFVDVTSTY

SEQ ID NO: 38722 - protein, 10 aa, Artificial Sequence
  Peptide Derived from Human Papillomavirus
LFVDVTSTYH

SEQ ID NO: 38723 - protein, 10 aa, Artificial Sequence
  Peptide Derived from Human Papillomavirus
LSHVKIPVVY

SEQ ID NO: 38724 - protein, 11 aa, Artificial Sequence
  Peptide Derived from Human Papillomavirus
LSHVKIPVVYR

SEQ ID NO: 38725 - protein, 8 aa, Artificial Sequence
  Peptide Derived from Human Papillomavirus
LTEPKKCF

SEQ ID NO: 38726 - protein, 9 aa, Artificial Sequence
  Peptide Derived from Human Papillomavirus
LTEPKKCFK

SEQ ID NO: 38727 - protein, 10 aa, Artificial Sequence
  Peptide Derived from Human Papillomavirus
LTEPKKCFKK

SEQ ID NO: 38728 - protein, 9 aa, Artificial Sequence
  Peptide Derived from Human Papillomavirus
MVPCLQVCK

SEQ ID NO: 38729 - protein, 10 aa, Artificial Sequence
  Peptide Derived from Human Papillomavirus
MVPCLQVCKA

SEQ ID NO: 38730 - protein, 11 aa, Artificial Sequence
  Peptide Derived from Human Papillomavirus
MVPCLQVCKAK

SEQ ID NO: 38731 - protein, 9 aa, Artificial Sequence
  Peptide Derived from Human Papillomavirus
NCMQYVAWK

SEQ ID NO: 38732 - protein, 10 aa, Artificial Sequence
  Peptide Derived from Human Papillomavirus
NCMQYVAWKY

SEQ ID NO: 38733 - protein, 8 aa, Artificial Sequence
  Peptide Derived from Human Papillomavirus
NGDCGWQK

SEQ ID NO: 38734 - protein, 8 aa, Artificial Sequence
  Peptide Derived from Human Papillomavirus
NSFLSHVK

SEQ ID NO: 38735 - protein, 11 aa, Artificial Sequence
  Peptide Derived from Human Papillomavirus
NVSPVETVNEY

SEQ ID NO: 38736 - protein, 8 aa, Artificial Sequence
  Peptide Derived from Human Papillomavirus
PCLQVCKA

SEQ ID NO: 38737 - protein, 9 aa, Artificial Sequence
  Peptide Derived from Human Papillomavirus
PCLQVCKAK

SEQ ID NO: 38738 - protein, 10 aa, Artificial Sequence
  Peptide Derived from Human Papillomavirus
PCLQVCKAKA

SEQ ID NO: 38739 - protein, 9 aa, Artificial Sequence
  Peptide Derived from Human Papillomavirus
PDSVSSTCR

SEQ ID NO: 38740 - protein, 10 aa, Artificial Sequence
  Peptide Derived from Human Papillomavirus
PDSVSSTCRY

SEQ ID NO: 38741 - protein, 10 aa, Artificial Sequence
  Peptide Derived from Human Papillomavirus
PGDKTTPVVH

SEQ ID NO: 38742 - protein, 8 aa, Artificial Sequence
  Peptide Derived from Human Papillomavirus
PGKRPRLR

SEQ ID NO: 38743 - protein, 8 aa, Artificial Sequence
  Peptide Derived from Human Papillomavirus
PVETVNEY

SEQ ID NO: 38744 - protein, 11 aa, Artificial Sequence
  Peptide Derived from Human Papillomavirus
PVETVNEYNTH

SEQ ID NO: 38745 - protein, 11 aa, Artificial Sequence
  Peptide Derived from Human Papillomavirus
PVVHLKGEPNR

SEQ ID NO: 38746 - protein, 10 aa, Artificial Sequence
  Peptide Derived from Human Papillomavirus
PVVYRLVWDK

SEQ ID NO: 38747 - protein, 8 aa, Artificial Sequence
  Peptide Derived from Human Papillomavirus
QDAAVSHR

SEQ ID NO: 38748 - protein, 11 aa, Artificial Sequence
  Peptide Derived from Human Papillomavirus
QDAAVSHRPGK

SEQ ID NO: 38749 - protein, 10 aa, Artificial Sequence
  Peptide Derived from Human Papillomavirus
QVCKAKACSA

SEQ ID NO: 38750 - protein, 9 aa, Artificial Sequence
  Peptide Derived from Human Papillomavirus
RFQKYKTLF

SEQ ID NO: 38751 - protein, 10 aa, Artificial Sequence
  Peptide Derived from Human Papillomavirus
RGIYYVHDGH

SEQ ID NO: 38752 - protein, 11 aa, Artificial Sequence
  Peptide Derived from Human Papillomavirus
RGIYYVHDGHK

SEQ ID NO: 38753 - protein, 8 aa, Artificial Sequence
  Peptide Derived from Human Papillomavirus
RLKCCRYR

SEQ ID NO: 38754 - protein, 9 aa, Artificial Sequence
  Peptide Derived from Human Papillomavirus
RLKCCRYRF

SEQ ID NO: 38755 - protein, 11 aa, Artificial Sequence
  Peptide Derived from Human Papillomavirus
RLKCCRYRFQK

SEQ ID NO: 38756 - protein, 11 aa, Artificial Sequence
  Peptide Derived from Human Papillomavirus
RLRESEFDSSR

SEQ ID NO: 38757 - protein, 8 aa, Artificial Sequence
  Peptide Derived from Human Papillomavirus
RSINNNNH

SEQ ID NO: 38758 - protein, 10 aa, Artificial Sequence
  Peptide Derived from Human Papillomavirus
RSRSINNNNH

SEQ ID NO: 38759 - protein, 8 aa, Artificial Sequence
  Peptide Derived from Human Papillomavirus
SAIEVQIA

SEQ ID NO: 38760 - protein, 9 aa, Artificial Sequence
  Peptide Derived from Human Papillomavirus
SDTDNTDSR

SEQ ID NO: 38761 - protein, 11 aa, Artificial Sequence
  Peptide Derived from Human Papillomavirus
SDTDNTDSRSR

SEQ ID NO: 38762 - protein, 9 aa, Artificial Sequence
  Peptide Derived from Human Papillomavirus
SGVDYRGIY

SEQ ID NO: 38763 - protein, 10 aa, Artificial Sequence
  Peptide Derived from Human Papillomavirus
SGVDYRGIYY

SEQ ID NO: 38764 - protein, 8 aa, Artificial Sequence
  Peptide Derived from Human Papillomavirus
SIITIIYK

SEQ ID NO: 38765 - protein, 11 aa, Artificial Sequence
  Peptide Derived from Human Papillomavirus
SINNNNHPGDK

SEQ ID NO: 38766 - protein, 8 aa, Artificial Sequence
  Peptide Derived from Human Papillomavirus
SSRESHAK

SEQ ID NO: 38767 - protein, 9 aa, Artificial Sequence
  Peptide Derived from Human Papillomavirus
STSVGNQDA

SEQ ID NO: 38768 - protein, 10 aa, Artificial Sequence
  Peptide Derived from Human Papillomavirus
STSVGNQDAA

SEQ ID NO: 38769 - protein, 11 aa, Artificial Sequence
  Peptide Derived from Human Papillomavirus
STYHWTSTDNK

SEQ ID NO: 38770 - protein, 8 aa, Artificial Sequence
  Peptide Derived from Human Papillomavirus
SVGNQDAA

SEQ ID NO: 38771 - protein, 11 aa, Artificial Sequence
  Peptide Derived from Human Papillomavirus
SVGNQDAAVSH

SEQ ID NO: 38772 - protein, 8 aa, Artificial Sequence
  Peptide Derived from Human Papillomavirus
SVSSTCRY

SEQ ID NO: 38773 - protein, 11 aa, Artificial Sequence
  Peptide Derived from Human Papillomavirus
TCEELWLTEPK

SEQ ID NO: 38774 - protein, 8 aa, Artificial Sequence
  Peptide Derived from Human Papillomavirus
TDFEQEAK

SEQ ID NO: 38775 - protein, 9 aa, Artificial Sequence
  Peptide Derived from Human Papillomavirus
TDFEQEAKK

SEQ ID NO: 38776 - protein, 10 aa, Artificial Sequence
  Peptide Derived from Human Papillomavirus
TDFEQEAKKF

SEQ ID NO: 38777 - protein, 9 aa, Artificial Sequence
  Peptide Derived from Human Papillomavirus
TDNTDSRSR

SEQ ID NO: 38778 - protein, 10 aa, Artificial Sequence
  Peptide Derived from Human Papillomavirus
TIIYKDETQR

SEQ ID NO: 38779 - protein, 11 aa, Artificial Sequence
  Peptide Derived from Human Papillomavirus
TIYNNEEWTLR

SEQ ID NO: 38780 - protein, 10 aa, Artificial Sequence
  Peptide Derived from Human Papillomavirus
TLFVDVTSTY

SEQ ID NO: 38781 - protein, 11 aa, Artificial Sequence
  Peptide Derived from Human Papillomavirus
TLFVDVTSTYH

SEQ ID NO: 38782 - protein, 8 aa, Artificial Sequence
  Peptide Derived from Human Papillomavirus
TSTDNKNY

SEQ ID NO: 38783 - protein, 10 aa, Artificial Sequence
  Peptide Derived from Human Papillomavirus
TSTSVGNQDA

SEQ ID NO: 38784 - protein, 11 aa, Artificial Sequence
  Peptide Derived from Human Papillomavirus
TSTSVGNQDAA

SEQ ID NO: 38785 - protein, 8 aa, Artificial Sequence
  Peptide Derived from Human Papillomavirus
TSVGNQDA

SEQ ID NO: 38786 - protein, 9 aa, Artificial Sequence
  Peptide Derived from Human Papillomavirus
TSVGNQDAA

SEQ ID NO: 38787 - protein, 8 aa, Artificial Sequence
  Peptide Derived from Human Papillomavirus
TTPVVHLK

SEQ ID NO: 38788 - protein, 11 aa, Artificial Sequence
  Peptide Derived from Human Papillomavirus
TTSTSVGNQDA

SEQ ID NO: 38789 - protein, 8 aa, Artificial Sequence
  Peptide Derived from Human Papillomavirus
TVNEYNTH

SEQ ID NO: 38790 - protein, 9 aa, Artificial Sequence
  Peptide Derived from Human Papillomavirus
TVNEYNTHK

SEQ ID NO: 38791 - protein, 8 aa, Artificial Sequence
  Peptide Derived from Human Papillomavirus
VAWKYIYY

SEQ ID NO: 38792 - protein, 9 aa, Artificial Sequence
  Peptide Derived from Human Papillomavirus
VCKAKACSA

SEQ ID NO: 38793 - protein, 8 aa, Artificial Sequence
  Peptide Derived from Human Papillomavirus
VCSGVDYR

SEQ ID NO: 38794 - protein, 11 aa, Artificial Sequence
  Peptide Derived from Human Papillomavirus
VCSGVDYRGIY

SEQ ID NO: 38795 - protein, 8 aa, Artificial Sequence
  Peptide Derived from Human Papillomavirus
VDVTSTYH

SEQ ID NO: 38796 - protein, 8 aa, Artificial Sequence
  Peptide Derived from Human Papillomavirus
VDYRGIYY

SEQ ID NO: 38797 - protein, 10 aa, Artificial Sequence
  Peptide Derived from Human Papillomavirus
VDYRGIYYVH

SEQ ID NO: 38798 - protein, 10 aa, Artificial Sequence
  Peptide Derived from Human Papillomavirus
VGNQDAAVSH

SEQ ID NO: 38799 - protein, 11 aa, Artificial Sequence
  Peptide Derived from Human Papillomavirus
VGNQDAAVSHR

SEQ ID NO: 38800 - protein, 8 aa, Artificial Sequence
  Peptide Derived from Human Papillomavirus
VSHRPGKR

SEQ ID NO: 38801 - protein, 10 aa, Artificial Sequence
  Peptide Derived from Human Papillomavirus
VSHRPGKRPR

SEQ ID NO: 38802 - protein, 10 aa, Artificial Sequence
  Peptide Derived from Human Papillomavirus
VSPVETVNEY

SEQ ID NO: 38803 - protein, 10 aa, Artificial Sequence
  Peptide Derived from Human Papillomavirus
VVHLKGEPNR

SEQ ID NO: 38804 - protein, 9 aa, Artificial Sequence
  Peptide Derived from Human Papillomavirus
VVYRLVWDK

SEQ ID NO: 38805 - protein, 9 aa, Artificial Sequence
  Peptide Derived from Human Papillomavirus
WLTEPKKCF

SEQ ID NO: 38806 - protein, 10 aa, Artificial Sequence
  Peptide Derived from Human Papillomavirus
WLTEPKKCFK

SEQ ID NO: 38807 - protein, 11 aa, Artificial Sequence
  Peptide Derived from Human Papillomavirus
WLTEPKKCFKK

SEQ ID NO: 38808 - protein, 9 aa, Artificial Sequence
  Peptide Derived from Human Papillomavirus
WTSTDNKNY

SEQ ID NO: 38809 - protein, 11 aa, Artificial Sequence
  Peptide Derived from Human Papillomavirus
YCPDSVSSTCR

SEQ ID NO: 38810 - protein, 8 aa, Artificial Sequence
  Peptide Derived from Human Papillomavirus
YSIITIIY

SEQ ID NO: 38811 - protein, 9 aa, Artificial Sequence
  Peptide Derived from Human Papillomavirus
YSIITIIYK

SEQ ID NO: 38812 - protein, 8 aa, Artificial Sequence
  Peptide Derived from Human Papillomavirus
YTDFEQEA

SEQ ID NO: 38813 - protein, 9 aa, Artificial Sequence
  Peptide Derived from Human Papillomavirus
YTDFEQEAK

SEQ ID NO: 38814 - protein, 10 aa, Artificial Sequence
  Peptide Derived from Human Papillomavirus
YTDFEQEAKK

SEQ ID NO: 38815 - protein, 11 aa, Artificial Sequence
  Peptide Derived from Human Papillomavirus
YTDFEQEAKKF

SEQ ID NO: 38816 - protein, 8 aa, Artificial Sequence
  Peptide Derived from Human Papillomavirus
YVAWKYIY

SEQ ID NO: 38817 - protein, 9 aa, Artificial Sequence
  Peptide Derived from Human Papillomavirus
YVAWKYIYY

SEQ ID NO: 38818 - protein, 9 aa, Artificial Sequence
  Peptide Derived from Human Papillomavirus
YVHDGHKTY

SEQ ID NO: 38819 - protein, 10 aa, Artificial Sequence
  Peptide Derived from Human Papillomavirus
YVHDGHKTYY

SEQ ID NO: 38820 - protein, 9 aa, Artificial Sequence
  Peptide Derived from Human Papillomavirus
ACTELKLVY

SEQ ID NO: 38821 - protein, 10 aa, Artificial Sequence
  Peptide Derived from Human Papillomavirus
ACTELKLVYR

SEQ ID NO: 38822 - protein, 8 aa, Artificial Sequence
  Peptide Derived from Human Papillomavirus
ATLESITK

SEQ ID NO: 38823 - protein, 9 aa, Artificial Sequence
  Peptide Derived from Human Papillomavirus
ATLESITKK

SEQ ID NO: 38824 - protein, 9 aa, Artificial Sequence
  Peptide Derived from Human Papillomavirus
AVCRVCLLF

SEQ ID NO: 38825 - protein, 10 aa, Artificial Sequence
  Peptide Derived from Human Papillomavirus
AVCRVCLLFY

SEQ ID NO: 38826 - protein, 8 aa, Artificial Sequence
  Peptide Derived from Human Papillomavirus
CDLLIRCY

SEQ ID NO: 38827 - protein, 9 aa, Artificial Sequence
  Peptide Derived from Human Papillomavirus
CDLLIRCYR

SEQ ID NO: 38828 - protein, 8 aa, Artificial Sequence
  Peptide Derived from Human Papillomavirus
CDRKRRFH

SEQ ID NO: 38829 - protein, 11 aa, Artificial Sequence
  Peptide Derived from Human Papillomavirus
CDRKRRFHLIA

SEQ ID NO: 38830 - protein, 10 aa, Artificial Sequence
  Peptide Derived from Human Papillomavirus
CLGCWRQTSR

SEQ ID NO: 38831 - protein, 9 aa, Artificial Sequence
  Peptide Derived from Human Papillomavirus
CLLFYSKVR

SEQ ID NO: 38832 - protein, 10 aa, Artificial Sequence
  Peptide Derived from Human Papillomavirus
CLLFYSKVRK

SEQ ID NO: 38833 - protein, 11 aa, Artificial Sequence
  Peptide Derived from Human Papillomavirus
CLLFYSKVRKY

SEQ ID NO: 38834 - protein, 8 aa, Artificial Sequence
  Peptide Derived from Human Papillomavirus
CTELKLVY

SEQ ID NO: 38835 - protein, 9 aa, Artificial Sequence
  Peptide Derived from Human Papillomavirus
CTELKLVYR

SEQ ID NO: 38836 - protein, 10 aa, Artificial Sequence
  Peptide Derived from Human Papillomavirus
CVYCKKELTR

SEQ ID NO: 38837 - protein, 11 aa, Artificial Sequence
  Peptide Derived from Human Papillomavirus
CVYCKKELTRA

SEQ ID NO: 38838 - protein, 9 aa, Artificial Sequence
  Peptide Derived from Human Papillomavirus
DDFPYAVCR

SEQ ID NO: 38839 - protein, 8 aa, Artificial Sequence
  Peptide Derived from Human Papillomavirus
DFPYAVCR

SEQ ID NO: 38840 - protein, 8 aa, Artificial Sequence
  Peptide Derived from Human Papillomavirus
DLLIRCYR

SEQ ID NO: 38841 - protein, 8 aa, Artificial Sequence
  Peptide Derived from Human Papillomavirus
DLRLSCVY

SEQ ID NO: 38842 - protein, 10 aa, Artificial Sequence
  Peptide Derived from Human Papillomavirus
DLRLSCVYCK

SEQ ID NO: 38843 - protein, 11 aa, Artificial Sequence
  Peptide Derived from Human Papillomavirus
DLRLSCVYCKK

SEQ ID NO: 38844 - protein, 8 aa, Artificial Sequence
  Peptide Derived from Human Papillomavirus
EIPLIDLR

SEQ ID NO: 38845 - protein, 10 aa, Artificial Sequence
  Peptide Derived from Human Papillomavirus
ELKLVYRDDF

SEQ ID NO: 38846 - protein, 8 aa, Artificial Sequence
  Peptide Derived from Human Papillomavirus
ELTRAEVY

SEQ ID NO: 38847 - protein, 10 aa, Artificial Sequence
  Peptide Derived from Human Papillomavirus
ELTRAEVYNF

SEQ ID NO: 38848 - protein, 11 aa, Artificial Sequence
  Peptide Derived from Human Papillomavirus
ELTRAEVYNFA

SEQ ID NO: 38849 - protein, 11 aa, Artificial Sequence
  Peptide Derived from Human Papillomavirus
EVLEIPLIDLR

SEQ ID NO: 38850 - protein, 11 aa, Artificial Sequence
  Peptide Derived from Human Papillomavirus
EVYNFACTELK

SEQ ID NO: 38851 - protein, 10 aa, Artificial Sequence
  Peptide Derived from Human Papillomavirus
FACTELKLVY

SEQ ID NO: 38852 - protein, 11 aa, Artificial Sequence
  Peptide Derived from Human Papillomavirus
FACTELKLVYR

SEQ ID NO: 38853 - protein, 9 aa, Artificial Sequence
  Peptide Derived from Human Papillomavirus
GATLESITK

SEQ ID NO: 38854 - protein, 10 aa, Artificial Sequence
  Peptide Derived from Human Papillomavirus
GATLESITKK

SEQ ID NO: 38855 - protein, 8 aa, Artificial Sequence
  Peptide Derived from Human Papillomavirus
GCWRQTSR

SEQ ID NO: 38856 - protein, 11 aa, Artificial Sequence
  Peptide Derived from Human Papillomavirus
GCWRQTSREPR

SEQ ID NO: 38857 - protein, 8 aa, Artificial Sequence
  Peptide Derived from Human Papillomavirus
GSCLGCWR

SEQ ID NO: 38858 - protein, 8 aa, Artificial Sequence
  Peptide Derived from Human Papillomavirus
HCDRKRRF

SEQ ID NO: 38859 - protein, 9 aa, Artificial Sequence
  Peptide Derived from Human Papillomavirus
HCDRKRRFH

SEQ ID NO: 38860 - protein, 9 aa, Artificial Sequence
  Peptide Derived from Human Papillomavirus
IDLRLSCVY

SEQ ID NO: 38861 - protein, 11 aa, Artificial Sequence
  Peptide Derived from Human Papillomavirus
IDLRLSCVYCK

SEQ ID NO: 38862 - protein, 8 aa, Artificial Sequence
  Peptide Derived from Human Papillomavirus
KLVYRDDF

SEQ ID NO: 38863 - protein, 10 aa, Artificial Sequence
  Peptide Derived from Human Papillomavirus
KLVYRDDFPY

SEQ ID NO: 38864 - protein, 11 aa, Artificial Sequence
  Peptide Derived from Human Papillomavirus
KLVYRDDFPYA

SEQ ID NO: 38865 - protein, 8 aa, Artificial Sequence
  Peptide Derived from Human Papillomavirus
KVRKYRYY

SEQ ID NO: 38866 - protein, 10 aa, Artificial Sequence
  Peptide Derived from Human Papillomavirus
KVRKYRYYDY

SEQ ID NO: 38867 - protein, 9 aa, Artificial Sequence
  Peptide Derived from Human Papillomavirus
LCDLLIRCY

SEQ ID NO: 38868 - protein, 10 aa, Artificial Sequence
  Peptide Derived from Human Papillomavirus
LCDLLIRCYR

SEQ ID NO: 38869 - protein, 8 aa, Artificial Sequence
  Peptide Derived from Human Papillomavirus
LFYSKVRK

SEQ ID NO: 38870 - protein, 9 aa, Artificial Sequence
  Peptide Derived from Human Papillomavirus
LFYSKVRKY

SEQ ID NO: 38871 - protein, 10 aa, Artificial Sequence
  Peptide Derived from Human Papillomavirus
LFYSKVRKYR

SEQ ID NO: 38872 - protein, 11 aa, Artificial Sequence
  Peptide Derived from Human Papillomavirus
LFYSKVRKYRY

SEQ ID NO: 38873 - protein, 9 aa, Artificial Sequence
  Peptide Derived from Human Papillomavirus
LGCWRQTSR

SEQ ID NO: 38874 - protein, 10 aa, Artificial Sequence
  Peptide Derived from Human Papillomavirus
LIDLRLSCVY

SEQ ID NO: 38875 - protein, 8 aa, Artificial Sequence
  Peptide Derived from Human Papillomavirus
LLFYSKVR

SEQ ID NO: 38876 - protein, 9 aa, Artificial Sequence
  Peptide Derived from Human Papillomavirus
LLFYSKVRK

SEQ ID NO: 38877 - protein, 10 aa, Artificial Sequence
  Peptide Derived from Human Papillomavirus
LLFYSKVRKY

SEQ ID NO: 38878 - protein, 11 aa, Artificial Sequence
  Peptide Derived from Human Papillomavirus
LLFYSKVRKYR

SEQ ID NO: 38879 - protein, 8 aa, Artificial Sequence
  Peptide Derived from Human Papillomavirus
LSCVYCKK

SEQ ID NO: 38880 - protein, 9 aa, Artificial Sequence
  Peptide Derived from Human Papillomavirus
LTPEEKQLH

SEQ ID NO: 38881 - protein, 9 aa, Artificial Sequence
  Peptide Derived from Human Papillomavirus
LTRAEVYNF

SEQ ID NO: 38882 - protein, 10 aa, Artificial Sequence
  Peptide Derived from Human Papillomavirus
LTRAEVYNFA

SEQ ID NO: 38883 - protein, 9 aa, Artificial Sequence
  Peptide Derived from Human Papillomavirus
LVYRDDFPY

SEQ ID NO: 38884 - protein, 10 aa, Artificial Sequence
  Peptide Derived from Human Papillomavirus
LVYRDDFPYA

SEQ ID NO: 38885 - protein, 8 aa, Artificial Sequence
  Peptide Derived from Human Papillomavirus
NFACTELK

SEQ ID NO: 38886 - protein, 11 aa, Artificial Sequence
  Peptide Derived from Human Papillomavirus
NFACTELKLVY

SEQ ID NO: 38887 - protein, 11 aa, Artificial Sequence
  Peptide Derived from Human Papillomavirus
PLIDLRLSCVY

SEQ ID NO: 38888 - protein, 10 aa, Artificial Sequence
  Peptide Derived from Human Papillomavirus
PLTPEEKQLH

SEQ ID NO: 38889 - protein, 8 aa, Artificial Sequence
  Peptide Derived from Human Papillomavirus
QFNNPQER

SEQ ID NO: 38890 - protein, 10 aa, Artificial Sequence
  Peptide Derived from Human Papillomavirus
QFNNPQERPR

SEQ ID NO: 38891 - protein, 8 aa, Artificial Sequence
  Peptide Derived from Human Papillomavirus
QLCDLLIR

SEQ ID NO: 38892 - protein, 10 aa, Artificial Sequence
  Peptide Derived from Human Papillomavirus
QLCDLLIRCY

SEQ ID NO: 38893 - protein, 11 aa, Artificial Sequence
  Peptide Derived from Human Papillomavirus
QLCDLLIRCYR

SEQ ID NO: 38894 - protein, 8 aa, Artificial Sequence
  Peptide Derived from Human Papillomavirus
QLHCDRKR

SEQ ID NO: 38895 - protein, 9 aa, Artificial Sequence
  Peptide Derived from Human Papillomavirus
QLHCDRKRR

SEQ ID NO: 38896 - protein, 10 aa, Artificial Sequence
  Peptide Derived from Human Papillomavirus
QLHCDRKRRF

SEQ ID NO: 38897 - protein, 11 aa, Artificial Sequence
  Peptide Derived from Human Papillomavirus
QLHCDRKRRFH

SEQ ID NO: 38898 - protein, 9 aa, Artificial Sequence
  Peptide Derived from Human Papillomavirus
QSPLTPEEK

SEQ ID NO: 38899 - protein, 8 aa, Artificial Sequence
  Peptide Derived from Human Papillomavirus
RAEVYNFA

SEQ ID NO: 38900 - protein, 11 aa, Artificial Sequence
  Peptide Derived from Human Papillomavirus
RCQSPLTPEEK

SEQ ID NO: 38901 - protein, 10 aa, Artificial Sequence
  Peptide Derived from Human Papillomavirus
RDDFPYAVCR

SEQ ID NO: 38902 - protein, 8 aa, Artificial Sequence
  Peptide Derived from Human Papillomavirus
RLSCVYCK

SEQ ID NO: 38903 - protein, 9 aa, Artificial Sequence
  Peptide Derived from Human Papillomavirus
RLSCVYCKK

SEQ ID NO: 38904 - protein, 9 aa, Artificial Sequence
  Peptide Derived from Human Papillomavirus
RVCLLFYSK

SEQ ID NO: 38905 - protein, 11 aa, Artificial Sequence
  Peptide Derived from Human Papillomavirus
RVCLLFYSKVR

SEQ ID NO: 38906 - protein, 11 aa, Artificial Sequence
  Peptide Derived from Human Papillomavirus
SCLGCWRQTSR

SEQ ID NO: 38907 - protein, 11 aa, Artificial Sequence
  Peptide Derived from Human Papillomavirus
SCVYCKKELTR

SEQ ID NO: 38908 - protein, 9 aa, Artificial Sequence
  Peptide Derived from Human Papillomavirus
TGSCLGCWR

SEQ ID NO: 38909 - protein, 8 aa, Artificial Sequence
  Peptide Derived from Human Papillomavirus
TLESITKK

SEQ ID NO: 38910 - protein, 8 aa, Artificial Sequence
  Peptide Derived from Human Papillomavirus
VCLLFYSK

SEQ ID NO: 38911 - protein, 10 aa, Artificial Sequence
  Peptide Derived from Human Papillomavirus
VCLLFYSKVR

SEQ ID NO: 38912 - protein, 11 aa, Artificial Sequence
  Peptide Derived from Human Papillomavirus
VCLLFYSKVRK

SEQ ID NO: 38913 - protein, 8 aa, Artificial Sequence
  Peptide Derived from Human Papillomavirus
VCRVCLLF

SEQ ID NO: 38914 - protein, 9 aa, Artificial Sequence
  Peptide Derived from Human Papillomavirus
VCRVCLLFY

SEQ ID NO: 38915 - protein, 11 aa, Artificial Sequence
  Peptide Derived from Human Papillomavirus
VCRVCLLFYSK

SEQ ID NO: 38916 - protein, 10 aa, Artificial Sequence
  Peptide Derived from Human Papillomavirus
VLEIPLIDLR

SEQ ID NO: 38917 - protein, 10 aa, Artificial Sequence
  Peptide Derived from Human Papillomavirus
WTGSCLGCWR

SEQ ID NO: 38918 - protein, 10 aa, Artificial Sequence
  Peptide Derived from Human Papillomavirus
YAVCRVCLLF

SEQ ID NO: 38919 - protein, 11 aa, Artificial Sequence
  Peptide Derived from Human Papillomavirus
YAVCRVCLLFY

SEQ ID NO: 38920 - protein, 8 aa, Artificial Sequence
  Peptide Derived from Human Papillomavirus
YCKKELTR

SEQ ID NO: 38921 - protein, 9 aa, Artificial Sequence
  Peptide Derived from Human Papillomavirus
YCKKELTRA

SEQ ID NO: 38922 - protein, 8 aa, Artificial Sequence
  Peptide Derived from Human Papillomavirus
YDYSVYGA

SEQ ID NO: 38923 - protein, 10 aa, Artificial Sequence
  Peptide Derived from Human Papillomavirus
YGATLESITK

SEQ ID NO: 38924 - protein, 11 aa, Artificial Sequence
  Peptide Derived from Human Papillomavirus
YGATLESITKK

SEQ ID NO: 38925 - protein, 8 aa, Artificial Sequence
  Peptide Derived from Human Papillomavirus
YSKVRKYR

SEQ ID NO: 38926 - protein, 9 aa, Artificial Sequence
  Peptide Derived from Human Papillomavirus
YSKVRKYRY

SEQ ID NO: 38927 - protein, 10 aa, Artificial Sequence
  Peptide Derived from Human Papillomavirus
YSKVRKYRYY

SEQ ID NO: 38928 - protein, 10 aa, Artificial Sequence
  Peptide Derived from Human Papillomavirus
ALTVTCPLCA

SEQ ID NO: 38929 - protein, 10 aa, Artificial Sequence
  Peptide Derived from Human Papillomavirus
DIQSTKEDLR

SEQ ID NO: 38930 - protein, 10 aa, Artificial Sequence
  Peptide Derived from Human Papillomavirus
EDEDEDEVDH

SEQ ID NO: 38931 - protein, 8 aa, Artificial Sequence
  Peptide Derived from Human Papillomavirus
EDEDEVDH

SEQ ID NO: 38932 - protein, 10 aa, Artificial Sequence
  Peptide Derived from Human Papillomavirus
EDEVDHLQER

SEQ ID NO: 38933 - protein, 8 aa, Artificial Sequence
  Peptide Derived from Human Papillomavirus
EVDHLQER

SEQ ID NO: 38934 - protein, 11 aa, Artificial Sequence
  Peptide Derived from Human Papillomavirus
FVVQLDIQSTK

SEQ ID NO: 38935 - protein, 11 aa, Artificial Sequence
  Peptide Derived from Human Papillomavirus
GALTVTCPLCA

SEQ ID NO: 38936 - protein, 9 aa, Artificial Sequence
  Peptide Derived from Human Papillomavirus
HLQERPQQA

SEQ ID NO: 38937 - protein, 10 aa, Artificial Sequence
  Peptide Derived from Human Papillomavirus
HLQERPQQAR

SEQ ID NO: 38938 - protein, 8 aa, Artificial Sequence
  Peptide Derived from Human Papillomavirus
HVPCCECK

SEQ ID NO: 38939 - protein, 9 aa, Artificial Sequence
  Peptide Derived from Human Papillomavirus
HVPCCECKF

SEQ ID NO: 38940 - protein, 11 aa, Artificial Sequence
  Peptide Derived from Human Papillomavirus
LDIQSTKEDLR

SEQ ID NO: 38941 - protein, 10 aa, Artificial Sequence
  Peptide Derived from Human Papillomavirus
LIHVPCCECK

SEQ ID NO: 38942 - protein, 11 aa, Artificial Sequence
  Peptide Derived from Human Papillomavirus
LIHVPCCECKF

SEQ ID NO: 38943 - protein, 9 aa, Artificial Sequence
  Peptide Derived from Human Papillomavirus
LTVTCPLCA

SEQ ID NO: 38944 - protein, 8 aa, Artificial Sequence
  Peptide Derived from Human Papillomavirus
QAKQHTCY

SEQ ID NO: 38945 - protein, 11 aa, Artificial Sequence
  Peptide Derived from Human Papillomavirus
QAKQHTCYLIH

SEQ ID NO: 38946 - protein, 8 aa, Artificial Sequence
  Peptide Derived from Human Papillomavirus
QARQAKQH

SEQ ID NO: 38947 - protein, 11 aa, Artificial Sequence
  Peptide Derived from Human Papillomavirus
QARQAKQHTCY

SEQ ID NO: 38948 - protein, 8 aa, Artificial Sequence
  Peptide Derived from Human Papillomavirus
QLDIQSTK

SEQ ID NO: 38949 - protein, 8 aa, Artificial Sequence
  Peptide Derived from Human Papillomavirus
QSTKEDLR

SEQ ID NO: 38950 - protein, 10 aa, Artificial Sequence
  Peptide Derived from Human Papillomavirus
RVVQQLLMGA

SEQ ID NO: 38951 - protein, 8 aa, Artificial Sequence
  Peptide Derived from Human Papillomavirus
TVTCPLCA

SEQ ID NO: 38952 - protein, 11 aa, Artificial Sequence
  Peptide Derived from Human Papillomavirus
VDHLQERPQQA

SEQ ID NO: 38953 - protein, 10 aa, Artificial Sequence
  Peptide Derived from Human Papillomavirus
VVQLDIQSTK

SEQ ID NO: 38954 - protein, 9 aa, Artificial Sequence
  Peptide Derived from Human Papillomavirus
VVQQLLMGA

SEQ ID NO: 38955 - protein, 11 aa, Artificial Sequence
  Peptide Derived from Human Papillomavirus
YLIHVPCCECK

SEQ ID NO: 38956 - protein, 9 aa, Artificial Sequence
  Peptide Derived from Human Papillomavirus
ACVGLEVGR

SEQ ID NO: 38957 - protein, 10 aa, Artificial Sequence
  Peptide Derived from Human Papillomavirus
ADAYGDSMWF

SEQ ID NO: 38958 - protein, 11 aa, Artificial Sequence
  Peptide Derived from Human Papillomavirus
ADAYGDSMWFY

SEQ ID NO: 38959 - protein, 10 aa, Artificial Sequence
  Peptide Derived from Human Papillomavirus
AGKVGETIPA

SEQ ID NO: 38960 - protein, 9 aa, Artificial Sequence
  Peptide Derived from Human Papillomavirus
AGLSGHPLF

SEQ ID NO: 38961 - protein, 11 aa, Artificial Sequence
  Peptide Derived from Human Papillomavirus
AGLSGHPLFNR

SEQ ID NO: 38962 - protein, 8 aa, Artificial Sequence
  Peptide Derived from Human Papillomavirus
AGSSRLLA

SEQ ID NO: 38963 - protein, 11 aa, Artificial Sequence
  Peptide Derived from Human Papillomavirus
AGSSRLLAVGH

SEQ ID NO: 38964 - protein, 11 aa, Artificial Sequence
  Peptide Derived from Human Papillomavirus
AMDFKVLQESK

SEQ ID NO: 38965 - protein, 8 aa, Artificial Sequence
  Peptide Derived from Human Papillomavirus
AMGEHWTK

SEQ ID NO: 38966 - protein, 10 aa, Artificial Sequence
  Peptide Derived from Human Papillomavirus
AMGEHWTKGA

SEQ ID NO: 38967 - protein, 8 aa, Artificial Sequence
  Peptide Derived from Human Papillomavirus
ATDSYVKR

SEQ ID NO: 38968 - protein, 8 aa, Artificial Sequence
  Peptide Derived from Human Papillomavirus
ATEQLSKY

SEQ ID NO: 38969 - protein, 10 aa, Artificial Sequence
  Peptide Derived from Human Papillomavirus
ATEQLSKYDA

SEQ ID NO: 38970 - protein, 11 aa, Artificial Sequence
  Peptide Derived from Human Papillomavirus
ATEQLSKYDAR

SEQ ID NO: 38971 - protein, 8 aa, Artificial Sequence
  Peptide Derived from Human Papillomavirus
ATSKKRSA

SEQ ID NO: 38972 - protein, 8 aa, Artificial Sequence
  Peptide Derived from Human Papillomavirus
ATSLEDKY

SEQ ID NO: 38973 - protein, 9 aa, Artificial Sequence
  Peptide Derived from Human Papillomavirus
ATSLEDKYR

SEQ ID NO: 38974 - protein, 10 aa, Artificial Sequence
  Peptide Derived from Human Papillomavirus
ATSLEDKYRY

SEQ ID NO: 38975 - protein, 9 aa, Artificial Sequence
  Peptide Derived from Human Papillomavirus
ATWRPSENK

SEQ ID NO: 38976 - protein, 11 aa, Artificial Sequence
  Peptide Derived from Human Papillomavirus
ATWRPSENKVY

SEQ ID NO: 38977 - protein, 8 aa, Artificial Sequence
  Peptide Derived from Human Papillomavirus
AVATSKKR

SEQ ID NO: 38978 - protein, 10 aa, Artificial Sequence
  Peptide Derived from Human Papillomavirus
AVATSKKRSA

SEQ ID NO: 38979 - protein, 11 aa, Artificial Sequence
  Peptide Derived from Human Papillomavirus
AVGHPYYSVTK

SEQ ID NO: 38980 - protein, 8 aa, Artificial Sequence
  Peptide Derived from Human Papillomavirus
AVNVFPIF

SEQ ID NO: 38981 - protein, 8 aa, Artificial Sequence
  Peptide Derived from Human Papillomavirus
CIFLDVGA

SEQ ID NO: 38982 - protein, 8 aa, Artificial Sequence
  Peptide Derived from Human Papillomavirus
CIVGCTPA

SEQ ID NO: 38983 - protein, 8 aa, Artificial Sequence
  Peptide Derived from Human Papillomavirus
CTPAMGEH

SEQ ID NO: 38984 - protein, 11 aa, Artificial Sequence
  Peptide Derived from Human Papillomavirus
CTPAMGEHWTK

SEQ ID NO: 38985 - protein, 8 aa, Artificial Sequence
  Peptide Derived from Human Papillomavirus
CVGLEVGR

SEQ ID NO: 38986 - protein, 8 aa, Artificial Sequence
  Peptide Derived from Human Papillomavirus
DARKINQY

SEQ ID NO: 38987 - protein, 10 aa, Artificial Sequence
  Peptide Derived from Human Papillomavirus
DARKINQYLR

SEQ ID NO: 38988 - protein, 11 aa, Artificial Sequence
  Peptide Derived from Human Papillomavirus
DARKINQYLRH

SEQ ID NO: 38989 - protein, 9 aa, Artificial Sequence
  Peptide Derived from Human Papillomavirus
DAYGDSMWF

SEQ ID NO: 38990 - protein, 10 aa, Artificial Sequence
  Peptide Derived from Human Papillomavirus
DAYGDSMWFY

SEQ ID NO: 38991 - protein, 9 aa, Artificial Sequence
  Peptide Derived from Human Papillomavirus
DDTESSNLA

SEQ ID NO: 38992 - protein, 9 aa, Artificial Sequence
  Peptide Derived from Human Papillomavirus
DFKVLQESK

SEQ ID NO: 38993 - protein, 10 aa, Artificial Sequence
  Peptide Derived from Human Papillomavirus
DFKVLQESKA

SEQ ID NO: 38994 - protein, 9 aa, Artificial Sequence
  Peptide Derived from Human Papillomavirus
DGDMIDTGF

SEQ ID NO: 38995 - protein, 11 aa, Artificial Sequence
  Peptide Derived from Human Papillomavirus
DGDMIDTGFGA

SEQ ID NO: 38996 - protein, 8 aa, Artificial Sequence
  Peptide Derived from Human Papillomavirus
DIVQSTCK

SEQ ID NO: 38997 - protein, 9 aa, Artificial Sequence
  Peptide Derived from Human Papillomavirus
DIVQSTCKY

SEQ ID NO: 38998 - protein, 9 aa, Artificial Sequence
  Peptide Derived from Human Papillomavirus
DLDQFPLGR

SEQ ID NO: 38999 - protein, 10 aa, Artificial Sequence
  Peptide Derived from Human Papillomavirus
DLDQFPLGRK

SEQ ID NO: 39000 - protein, 11 aa, Artificial Sequence
  Peptide Derived from Human Papillomavirus
DLDQFPLGRKF

SEQ ID NO: 39001 - protein, 9 aa, Artificial Sequence
  Peptide Derived from Human Papillomavirus
DMIDTGFGA

SEQ ID NO: 39002 - protein, 10 aa, Artificial Sequence
  Peptide Derived from Human Papillomavirus
DSFSTDLDQF

SEQ ID NO: 39003 - protein, 8 aa, Artificial Sequence
  Peptide Derived from Human Papillomavirus
DSMWFYLR

SEQ ID NO: 39004 - protein, 9 aa, Artificial Sequence
  Peptide Derived from Human Papillomavirus
DSMWFYLRR

SEQ ID NO: 39005 - protein, 11 aa, Artificial Sequence
  Peptide Derived from Human Papillomavirus
DSRDNISVDGK

SEQ ID NO: 39006 - protein, 10 aa, Artificial Sequence
  Peptide Derived from Human Papillomavirus
DSYVKRTSIF

SEQ ID NO: 39007 - protein, 11 aa, Artificial Sequence
  Peptide Derived from Human Papillomavirus
DSYVKRTSIFY

SEQ ID NO: 39008 - protein, 8 aa, Artificial Sequence
  Peptide Derived from Human Papillomavirus
DTESSNLA

SEQ ID NO: 39009 - protein, 9 aa, Artificial Sequence
  Peptide Derived from Human Papillomavirus
DTGFGAMDF

SEQ ID NO: 39010 - protein, 10 aa, Artificial Sequence
  Peptide Derived from Human Papillomavirus
DTGFGAMDFK

SEQ ID NO: 39011 - protein, 11 aa, Artificial Sequence
  Peptide Derived from Human Papillomavirus
DTNIYNPDQER

SEQ ID NO: 39012 - protein, 8 aa, Artificial Sequence
  Peptide Derived from Human Papillomavirus
DVGAVNVF

SEQ ID NO: 39013 - protein, 11 aa, Artificial Sequence
  Peptide Derived from Human Papillomavirus
DVGAVNVFPIF

SEQ ID NO: 39014 - protein, 8 aa, Artificial Sequence
  Peptide Derived from Human Papillomavirus
DVNLQDSF

SEQ ID NO: 39015 - protein, 9 aa, Artificial Sequence
  Peptide Derived from Human Papillomavirus
EAQLFNKPY

SEQ ID NO: 39016 - protein, 10 aa, Artificial Sequence
  Peptide Derived from Human Papillomavirus
EDGDMIDTGF

SEQ ID NO: 39017 - protein, 8 aa, Artificial Sequence
  Peptide Derived from Human Papillomavirus
EDKYRYVR

SEQ ID NO: 39018 - protein, 11 aa, Artificial Sequence
  Peptide Derived from Human Papillomavirus
EDKYRYVRSTA

SEQ ID NO: 39019 - protein, 10 aa, Artificial Sequence
  Peptide Derived from Human Papillomavirus
ELQFVFQLCK

SEQ ID NO: 39020 - protein, 10 aa, Artificial Sequence
  Peptide Derived from Human Papillomavirus
ELYLKGSNGR

SEQ ID NO: 39021 - protein, 8 aa, Artificial Sequence
  Peptide Derived from Human Papillomavirus
ETIPAELY

SEQ ID NO: 39022 - protein, 10 aa, Artificial Sequence
  Peptide Derived from Human Papillomavirus
ETIPAELYLK

SEQ ID NO: 39023 - protein, 10 aa, Artificial Sequence
  Peptide Derived from Human Papillomavirus
EVGRGQPLGA

SEQ ID NO: 39024 - protein, 11 aa, Artificial Sequence
  Peptide Derived from Human Papillomavirus
EVMAYLHNMNA

SEQ ID NO: 39025 - protein, 8 aa, Artificial Sequence
  Peptide Derived from Human Papillomavirus
FARHYFNR

SEQ ID NO: 39026 - protein, 9 aa, Artificial Sequence
  Peptide Derived from Human Papillomavirus
FARHYFNRA

SEQ ID NO: 39027 - protein, 11 aa, Artificial Sequence
  Peptide Derived from Human Papillomavirus
FARHYFNRAGK

SEQ ID NO: 39028 - protein, 9 aa, Artificial Sequence
  Peptide Derived from Human Papillomavirus
FGLPDTNIY

SEQ ID NO: 39029 - protein, 10 aa, Artificial Sequence
  Peptide Derived from Human Papillomavirus
FLDVGAVNVF

SEQ ID NO: 39030 - protein, 8 aa, Artificial Sequence
  Peptide Derived from Human Papillomavirus
FLMQLGTR

SEQ ID NO: 39031 - protein, 10 aa, Artificial Sequence
  Peptide Derived from Human Papillomavirus
FLMQLGTRSK

SEQ ID NO: 39032 - protein, 8 aa, Artificial Sequence
  Peptide Derived from Human Papillomavirus
FLQMATWR

SEQ ID NO: 39033 - protein, 8 aa, Artificial Sequence
  Peptide Derived from Human Papillomavirus
FSTDLDQF

SEQ ID NO: 39034 - protein, 9 aa, Artificial Sequence
  Peptide Derived from Human Papillomavirus
FVTVVDTTR

SEQ ID NO: 39035 - protein, 10 aa, Artificial Sequence
  Peptide Derived from Human Papillomavirus
GAGLSGHPLF

SEQ ID NO: 39036 - protein, 9 aa, Artificial Sequence
  Peptide Derived from Human Papillomavirus
GAVNVFPIF

SEQ ID NO: 39037 - protein, 9 aa, Artificial Sequence
  Peptide Derived from Human Papillomavirus
GCTPAMGEH

SEQ ID NO: 39038 - protein, 8 aa, Artificial Sequence
  Peptide Derived from Human Papillomavirus
GDMIDTGF

SEQ ID NO: 39039 - protein, 10 aa, Artificial Sequence
  Peptide Derived from Human Papillomavirus
GDMIDTGFGA

SEQ ID NO: 39040 - protein, 9 aa, Artificial Sequence
  Peptide Derived from Human Papillomavirus
GDSMWFYLR

SEQ ID NO: 39041 - protein, 10 aa, Artificial Sequence
  Peptide Derived from Human Papillomavirus
GDSMWFYLRR

SEQ ID NO: 39042 - protein, 8 aa, Artificial Sequence
  Peptide Derived from Human Papillomavirus
GFGAMDFK

SEQ ID NO: 39043 - protein, 9 aa, Artificial Sequence
  Peptide Derived from Human Papillomavirus
GICWGNQLF

SEQ ID NO: 39044 - protein, 10 aa, Artificial Sequence
  Peptide Derived from Human Papillomavirus
GLCIFLDVGA

SEQ ID NO: 39045 - protein, 8 aa, Artificial Sequence
  Peptide Derived from Human Papillomavirus
GLPDTNIY

SEQ ID NO: 39046 - protein, 8 aa, Artificial Sequence
  Peptide Derived from Human Papillomavirus
GLSGHPLF

SEQ ID NO: 39047 - protein, 10 aa, Artificial Sequence
  Peptide Derived from Human Papillomavirus
GLSGHPLFNR

SEQ ID NO: 39048 - protein, 8 aa, Artificial Sequence
  Peptide Derived from Human Papillomavirus
GSMITSEA

SEQ ID NO: 39049 - protein, 11 aa, Artificial Sequence
  Peptide Derived from Human Papillomavirus
GSMITSEAQLF

SEQ ID NO: 39050 - protein, 10 aa, Artificial Sequence
  Peptide Derived from Human Papillomavirus
GSSRLLAVGH

SEQ ID NO: 39051 - protein, 9 aa, Artificial Sequence
  Peptide Derived from Human Papillomavirus
GTRSKPAVA

SEQ ID NO: 39052 - protein, 9 aa, Artificial Sequence
  Peptide Derived from Human Papillomavirus
HAGSSRLLA

SEQ ID NO: 39053 - protein, 9 aa, Artificial Sequence
  Peptide Derived from Human Papillomavirus
HVEEYELQF

SEQ ID NO: 39054 - protein, 11 aa, Artificial Sequence
  Peptide Derived from Human Papillomavirus
HVEEYELQFVF

SEQ ID NO: 39055 - protein, 8 aa, Artificial Sequence
  Peptide Derived from Human Papillomavirus
ICWGNQLF

SEQ ID NO: 39056 - protein, 10 aa, Artificial Sequence
  Peptide Derived from Human Papillomavirus
IDTGFGAMDF

SEQ ID NO: 39057 - protein, 11 aa, Artificial Sequence
  Peptide Derived from Human Papillomavirus
IDTGFGAMDFK

SEQ ID NO: 39058 - protein, 11 aa, Artificial Sequence
  Peptide Derived from Human Papillomavirus
IFLDVGAVNVF

SEQ ID NO: 39059 - protein, 9 aa, Artificial Sequence
  Peptide Derived from Human Papillomavirus
IFLQMATWR

SEQ ID NO: 39060 - protein, 9 aa, Artificial Sequence
  Peptide Derived from Human Papillomavirus
IFYHAGSSR

SEQ ID NO: 39061 - protein, 8 aa, Artificial Sequence
  Peptide Derived from Human Papillomavirus
IGLSPPVA

SEQ ID NO: 39062 - protein, 10 aa, Artificial Sequence
  Peptide Derived from Human Papillomavirus
ISTATEQLSK

SEQ ID NO: 39063 - protein, 11 aa, Artificial Sequence
  Peptide Derived from Human Papillomavirus
ISTATEQLSKY

SEQ ID NO: 39064 - protein, 9 aa, Artificial Sequence
  Peptide Derived from Human Papillomavirus
ITLSAEVMA

SEQ ID NO: 39065 - protein, 10 aa, Artificial Sequence
  Peptide Derived from Human Papillomavirus
ITLSAEVMAY

SEQ ID NO: 39066 - protein, 8 aa, Artificial Sequence
  Peptide Derived from Human Papillomavirus
ITSEAQLF

SEQ ID NO: 39067 - protein, 10 aa, Artificial Sequence
  Peptide Derived from Human Papillomavirus
ITSEAQLFNK

SEQ ID NO: 39068 - protein, 11 aa, Artificial Sequence
  Peptide Derived from Human Papillomavirus
IVGCTPAMGEH

SEQ ID NO: 39069 - protein, 8 aa, Artificial Sequence
  Peptide Derived from Human Papillomavirus
IVQSTCKY

SEQ ID NO: 39070 - protein, 11 aa, Artificial Sequence
  Peptide Derived from Human Papillomavirus
IVQSTCKYPDY

SEQ ID NO: 39071 - protein, 10 aa, Artificial Sequence
  Peptide Derived from Human Papillomavirus
KDNTKTNIPK

SEQ ID NO: 39072 - protein, 10 aa, Artificial Sequence
  Peptide Derived from Human Papillomavirus
KFGLPDTNIY

SEQ ID NO: 39073 - protein, 9 aa, Artificial Sequence
  Peptide Derived from Human Papillomavirus
KFLMQLGTR

SEQ ID NO: 39074 - protein, 11 aa, Artificial Sequence
  Peptide Derived from Human Papillomavirus
KFLMQLGTRSK

SEQ ID NO: 39075 - protein, 11 aa, Artificial Sequence
  Peptide Derived from Human Papillomavirus
KFWDVNLQDSF

SEQ ID NO: 39076 - protein, 8 aa, Artificial Sequence
  Peptide Derived from Human Papillomavirus
KINQYLRH

SEQ ID NO: 39077 - protein, 10 aa, Artificial Sequence
  Peptide Derived from Human Papillomavirus
KITLSAEVMA

SEQ ID NO: 39078 - protein, 11 aa, Artificial Sequence
  Peptide Derived from Human Papillomavirus
KITLSAEVMAY

SEQ ID NO: 39079 - protein, 9 aa, Artificial Sequence
  Peptide Derived from Human Papillomavirus
KTNIPKVSA

SEQ ID NO: 39080 - protein, 10 aa, Artificial Sequence
  Peptide Derived from Human Papillomavirus
KTNIPKVSAY

SEQ ID NO: 39081 - protein, 8 aa, Artificial Sequence
  Peptide Derived from Human Papillomavirus
KVGETIPA

SEQ ID NO: 39082 - protein, 11 aa, Artificial Sequence
  Peptide Derived from Human Papillomavirus
KVGETIPAELY

SEQ ID NO: 39083 - protein, 8 aa, Artificial Sequence
  Peptide Derived from Human Papillomavirus
KVLQESKA

SEQ ID NO: 39084 - protein, 8 aa, Artificial Sequence
  Peptide Derived from Human Papillomavirus
KVSAYQYR

SEQ ID NO: 39085 - protein, 10 aa, Artificial Sequence
  Peptide Derived from Human Papillomavirus
KVSAYQYRVF

SEQ ID NO: 39086 - protein, 11 aa, Artificial Sequence
  Peptide Derived from Human Papillomavirus
KVSAYQYRVFR

SEQ ID NO: 39087 - protein, 8 aa, Artificial Sequence
  Peptide Derived from Human Papillomavirus
KVVATDSY

SEQ ID NO: 39088 - protein, 10 aa, Artificial Sequence
  Peptide Derived from Human Papillomavirus
KVVATDSYVK

SEQ ID NO: 39089 - protein, 11 aa, Artificial Sequence
  Peptide Derived from Human Papillomavirus
KVVATDSYVKR

SEQ ID NO: 39090 - protein, 11 aa, Artificial Sequence
  Peptide Derived from Human Papillomavirus
KVYLPPTPVSK

SEQ ID NO: 39091 - protein, 11 aa, Artificial Sequence
  Peptide Derived from Human Papillomavirus
LANNNVIEDSR

SEQ ID NO: 39092 - protein, 8 aa, Artificial Sequence
  Peptide Derived from Human Papillomavirus
LAVGHPYY

SEQ ID NO: 39093 - protein, 9 aa, Artificial Sequence
  Peptide Derived from Human Papillomavirus
LCIFLDVGA

SEQ ID NO: 39094 - protein, 9 aa, Artificial Sequence
  Peptide Derived from Human Papillomavirus
LCIVGCTPA

SEQ ID NO: 39095 - protein, 8 aa, Artificial Sequence
  Peptide Derived from Human Papillomavirus
LCKITLSA

SEQ ID NO: 39096 - protein, 10 aa, Artificial Sequence
  Peptide Derived from Human Papillomavirus
LDDTESSNLA

SEQ ID NO: 39097 - protein, 9 aa, Artificial Sequence
  Peptide Derived from Human Papillomavirus
LDIVQSTCK

SEQ ID NO: 39098 - protein, 10 aa, Artificial Sequence
  Peptide Derived from Human Papillomavirus
LDIVQSTCKY

SEQ ID NO: 39099 - protein, 8 aa, Artificial Sequence
  Peptide Derived from Human Papillomavirus
LDQFPLGR

SEQ ID NO: 39100 - protein, 9 aa, Artificial Sequence
  Peptide Derived from Human Papillomavirus
LDQFPLGRK

SEQ ID NO: 39101 - protein, 10 aa, Artificial Sequence
  Peptide Derived from Human Papillomavirus
LDQFPLGRKF

SEQ ID NO: 39102 - protein, 9 aa, Artificial Sequence
  Peptide Derived from Human Papillomavirus
LDVGAVNVF

SEQ ID NO: 39103 - protein, 9 aa, Artificial Sequence
  Peptide Derived from Human Papillomavirus
LFARHYFNR

SEQ ID NO: 39104 - protein, 10 aa, Artificial Sequence
  Peptide Derived from Human Papillomavirus
LFARHYFNRA

SEQ ID NO: 39105 - protein, 10 aa, Artificial Sequence
  Peptide Derived from Human Papillomavirus
LFNKPYWLQR

SEQ ID NO: 39106 - protein, 11 aa, Artificial Sequence
  Peptide Derived from Human Papillomavirus
LFNKPYWLQRA

SEQ ID NO: 39107 - protein, 10 aa, Artificial Sequence
  Peptide Derived from Human Papillomavirus
LFVTVVDTTR

SEQ ID NO: 39108 - protein, 8 aa, Artificial Sequence
  Peptide Derived from Human Papillomavirus
LGAGLSGH

SEQ ID NO: 39109 - protein, 11 aa, Artificial Sequence
  Peptide Derived from Human Papillomavirus
LGAGLSGHPLF

SEQ ID NO: 39110 - protein, 8 aa, Artificial Sequence
  Peptide Derived from Human Papillomavirus
LGTRSKPA

SEQ ID NO: 39111 - protein, 10 aa, Artificial Sequence
  Peptide Derived from Human Papillomavirus
LGTRSKPAVA

SEQ ID NO: 39112 - protein, 8 aa, Artificial Sequence
  Peptide Derived from Human Papillomavirus
LLAVGHPY

SEQ ID NO: 39113 - protein, 9 aa, Artificial Sequence
  Peptide Derived from Human Papillomavirus
LLAVGHPYY

SEQ ID NO: 39114 - protein, 9 aa, Artificial Sequence
  Peptide Derived from Human Papillomavirus
LMQLGTRSK

SEQ ID NO: 39115 - protein, 11 aa, Artificial Sequence
  Peptide Derived from Human Papillomavirus
LMQLGTRSKPA

SEQ ID NO: 39116 - protein, 8 aa, Artificial Sequence
  Peptide Derived from Human Papillomavirus
LSAEVMAY

SEQ ID NO: 39117 - protein, 10 aa, Artificial Sequence
  Peptide Derived from Human Papillomavirus
LSAEVMAYLH

SEQ ID NO: 39118 - protein, 9 aa, Artificial Sequence
  Peptide Derived from Human Papillomavirus
LSGHPLFNR

SEQ ID NO: 39119 - protein, 8 aa, Artificial Sequence
  Peptide Derived from Human Papillomavirus
LSKYDARK

SEQ ID NO: 39120 - protein, 10 aa, Artificial Sequence
  Peptide Derived from Human Papillomavirus
MATWRPSENK

SEQ ID NO: 39121 - protein, 9 aa, Artificial Sequence
  Peptide Derived from Human Papillomavirus
MAYLHNMNA

SEQ ID NO: 39122 - protein, 10 aa, Artificial Sequence
  Peptide Derived from Human Papillomavirus
MDFKVLQESK

SEQ ID NO: 39123 - protein, 11 aa, Artificial Sequence
  Peptide Derived from Human Papillomavirus
MDFKVLQESKA

SEQ ID NO: 39124 - protein, 9 aa, Artificial Sequence
  Peptide Derived from Human Papillomavirus
MGEHWTKGA

SEQ ID NO: 39125 - protein, 8 aa, Artificial Sequence
  Peptide Derived from Human Papillomavirus
MIDTGFGA

SEQ ID NO: 39126 - protein, 11 aa, Artificial Sequence
  Peptide Derived from Human Papillomavirus
MIDTGFGAMDF

SEQ ID NO: 39127 - protein, 9 aa, Artificial Sequence
  Peptide Derived from Human Papillomavirus
MITSEAQLF

SEQ ID NO: 39128 - protein, 11 aa, Artificial Sequence
  Peptide Derived from Human Papillomavirus
MITSEAQLFNK

SEQ ID NO: 39129 - protein, 8 aa, Artificial Sequence
  Peptide Derived from Human Papillomavirus
MLPMMYIY

SEQ ID NO: 39130 - protein, 9 aa, Artificial Sequence
  Peptide Derived from Human Papillomavirus
MLPMMYIYR

SEQ ID NO: 39131 - protein, 9 aa, Artificial Sequence
  Peptide Derived from Human Papillomavirus
MMLPMMYIY

SEQ ID NO: 39132 - protein, 10 aa, Artificial Sequence
  Peptide Derived from Human Papillomavirus
MMLPMMYIYR

SEQ ID NO: 39133 - protein, 11 aa, Artificial Sequence
  Peptide Derived from Human Papillomavirus
MMYIYRDPPLH

SEQ ID NO: 39134 - protein, 10 aa, Artificial Sequence
  Peptide Derived from Human Papillomavirus
NGICWGNQLF

SEQ ID NO: 39135 - protein, 11 aa, Artificial Sequence
  Peptide Derived from Human Papillomavirus
NGREPPPSSVY

SEQ ID NO: 39136 - protein, 9 aa, Artificial Sequence
  Peptide Derived from Human Papillomavirus
NIGLSPPVA

SEQ ID NO: 39137 - protein, 8 aa, Artificial Sequence
  Peptide Derived from Human Papillomavirus
NIPKVSAY

SEQ ID NO: 39138 - protein, 10 aa, Artificial Sequence
  Peptide Derived from Human Papillomavirus
NIPKVSAYQY

SEQ ID NO: 39139 - protein, 11 aa, Artificial Sequence
  Peptide Derived from Human Papillomavirus
NIPKVSAYQYR

SEQ ID NO: 39140 - protein, 9 aa, Artificial Sequence
  Peptide Derived from Human Papillomavirus
NIYNPDQER

SEQ ID NO: 39141 - protein, 8 aa, Artificial Sequence
  Peptide Derived from Human Papillomavirus
NTKTNIPK

SEQ ID NO: 39142 - protein, 11 aa, Artificial Sequence
  Peptide Derived from Human Papillomavirus
NTKTNIPKVSA

SEQ ID NO: 39143 - protein, 10 aa, Artificial Sequence
  Peptide Derived from Human Papillomavirus
NVFPIFLQMA

SEQ ID NO: 39144 - protein, 9 aa, Artificial Sequence
  Peptide Derived from Human Papillomavirus
PAMGEHWTK

SEQ ID NO: 39145 - protein, 11 aa, Artificial Sequence
  Peptide Derived from Human Papillomavirus
PAMGEHWTKGA

SEQ ID NO: 39146 - protein, 8 aa, Artificial Sequence
  Peptide Derived from Human Papillomavirus
PAVATSKK

SEQ ID NO: 39147 - protein, 9 aa, Artificial Sequence
  Peptide Derived from Human Papillomavirus
PAVATSKKR

SEQ ID NO: 39148 - protein, 11 aa, Artificial Sequence
  Peptide Derived from Human Papillomavirus
PAVATSKKRSA

SEQ ID NO: 39149 - protein, 9 aa, Artificial Sequence
  Peptide Derived from Human Papillomavirus
PDQERLVWA

SEQ ID NO: 39150 - protein, 8 aa, Artificial Sequence
  Peptide Derived from Human Papillomavirus
PDYLKMSA

SEQ ID NO: 39151 - protein, 10 aa, Artificial Sequence
  Peptide Derived from Human Papillomavirus
PDYLKMSADA

SEQ ID NO: 39152 - protein, 11 aa, Artificial Sequence
  Peptide Derived from Human Papillomavirus
PDYLKMSADAY

SEQ ID NO: 39153 - protein, 10 aa, Artificial Sequence
  Peptide Derived from Human Papillomavirus
PIFLQMATWR

SEQ ID NO: 39154 - protein, 10 aa, Artificial Sequence
  Peptide Derived from Human Papillomavirus
PLDIVQSTCK

SEQ ID NO: 39155 - protein, 11 aa, Artificial Sequence
  Peptide Derived from Human Papillomavirus
PLDIVQSTCKY

SEQ ID NO: 39156 - protein, 9 aa, Artificial Sequence
  Peptide Derived from Human Papillomavirus
PLGAGLSGH

SEQ ID NO: 39157 - protein, 9 aa, Artificial Sequence
  Peptide Derived from Human Papillomavirus
PLHYGLCIF

SEQ ID NO: 39158 - protein, 10 aa, Artificial Sequence
  Peptide Derived from Human Papillomavirus
PSGSMITSEA

SEQ ID NO: 39159 - protein, 9 aa, Artificial Sequence
  Peptide Derived from Human Papillomavirus
PTEKQDPLA

SEQ ID NO: 39160 - protein, 10 aa, Artificial Sequence
  Peptide Derived from Human Papillomavirus
PTEKQDPLAK

SEQ ID NO: 39161 - protein, 11 aa, Artificial Sequence
  Peptide Derived from Human Papillomavirus
PTEKQDPLAKY

SEQ ID NO: 39162 - protein, 9 aa, Artificial Sequence
  Peptide Derived from Human Papillomavirus
PTPVSKVVA

SEQ ID NO: 39163 - protein, 8 aa, Artificial Sequence
  Peptide Derived from Human Papillomavirus
PTSTSTPA

SEQ ID NO: 39164 - protein, 9 aa, Artificial Sequence
  Peptide Derived from Human Papillomavirus
PTSTSTPAK

SEQ ID NO: 39165 - protein, 10 aa, Artificial Sequence
  Peptide Derived from Human Papillomavirus
PTSTSTPAKR

SEQ ID NO: 39166 - protein, 11 aa, Artificial Sequence
  Peptide Derived from Human Papillomavirus
PTSTSTPAKRK

SEQ ID NO: 39167 - protein, 9 aa, Artificial Sequence
  Peptide Derived from Human Papillomavirus
PVATSLEDK

SEQ ID NO: 39168 - protein, 10 aa, Artificial Sequence
  Peptide Derived from Human Papillomavirus
PVATSLEDKY

SEQ ID NO: 39169 - protein, 11 aa, Artificial Sequence
  Peptide Derived from Human Papillomavirus
PVATSLEDKYR

SEQ ID NO: 39170 - protein, 11 aa, Artificial Sequence
  Peptide Derived from Human Papillomavirus
PVSKVVATDSY

SEQ ID NO: 39171 - protein, 8 aa, Artificial Sequence
  Peptide Derived from Human Papillomavirus
QDPLAKYK

SEQ ID NO: 39172 - protein, 9 aa, Artificial Sequence
  Peptide Derived from Human Papillomavirus
QDPLAKYKF

SEQ ID NO: 39173 - protein, 11 aa, Artificial Sequence
  Peptide Derived from Human Papillomavirus
QDSFSTDLDQF

SEQ ID NO: 39174 - protein, 8 aa, Artificial Sequence
  Peptide Derived from Human Papillomavirus
QFPLGRKF

SEQ ID NO: 39175 - protein, 8 aa, Artificial Sequence
  Peptide Derived from Human Papillomavirus
QFVFQLCK

SEQ ID NO: 39176 - protein, 10 aa, Artificial Sequence
  Peptide Derived from Human Papillomavirus
QLCIVGCTPA

SEQ ID NO: 39177 - protein, 9 aa, Artificial Sequence
  Peptide Derived from Human Papillomavirus
QLCKITLSA

SEQ ID NO: 39178 - protein, 8 aa, Artificial Sequence
  Peptide Derived from Human Papillomavirus
QLFARHYF

SEQ ID NO: 39179 - protein, 10 aa, Artificial Sequence
  Peptide Derived from Human Papillomavirus
QLFARHYFNR

SEQ ID NO: 39180 - protein, 11 aa, Artificial Sequence
  Peptide Derived from Human Papillomavirus
QLFARHYFNRA

SEQ ID NO: 39181 - protein, 11 aa, Artificial Sequence
  Peptide Derived from Human Papillomavirus
QLFNKPYWLQR

SEQ ID NO: 39182 - protein, 11 aa, Artificial Sequence
  Peptide Derived from Human Papillomavirus
QLFVTVVDTTR

SEQ ID NO: 39183 - protein, 9 aa, Artificial Sequence
  Peptide Derived from Human Papillomavirus
QLGTRSKPA

SEQ ID NO: 39184 - protein, 11 aa, Artificial Sequence
  Peptide Derived from Human Papillomavirus
QLGTRSKPAVA

SEQ ID NO: 39185 - protein, 8 aa, Artificial Sequence
  Peptide Derived from Human Papillomavirus
QLSKYDAR

SEQ ID NO: 39186 - protein, 9 aa, Artificial Sequence
  Peptide Derived from Human Papillomavirus
QLSKYDARK

SEQ ID NO: 39187 - protein, 11 aa, Artificial Sequence
  Peptide Derived from Human Papillomavirus
QMATWRPSENK

SEQ ID NO: 39188 - protein, 9 aa, Artificial Sequence
  Peptide Derived from Human Papillomavirus
QSTCKYPDY

SEQ ID NO: 39189 - protein, 11 aa, Artificial Sequence
  Peptide Derived from Human Papillomavirus
QSTCKYPDYLK

SEQ ID NO: 39190 - protein, 11 aa, Artificial Sequence
  Peptide Derived from Human Papillomavirus
QVTTGDCPPLA

SEQ ID NO: 39191 - protein, 11 aa, Artificial Sequence
  Peptide Derived from Human Papillomavirus
RAGKVGETIPA

SEQ ID NO: 39192 - protein, 9 aa, Artificial Sequence
  Peptide Derived from Human Papillomavirus
RDNISVDGK

SEQ ID NO: 39193 - protein, 11 aa, Artificial Sequence
  Peptide Derived from Human Papillomavirus
RLDDTESSNLA

SEQ ID NO: 39194 - protein, 9 aa, Artificial Sequence
  Peptide Derived from Human Papillomavirus
RLLAVGHPY

SEQ ID NO: 39195 - protein, 10 aa, Artificial Sequence
  Peptide Derived from Human Papillomavirus
RLLAVGHPYY

SEQ ID NO: 39196 - protein, 8 aa, Artificial Sequence
  Peptide Derived from Human Papillomavirus
RLPDPNKF

SEQ ID NO: 39197 - protein, 11 aa, Artificial Sequence
  Peptide Derived from Human Papillomavirus
RSAPTSTSTPA

SEQ ID NO: 39198 - protein, 10 aa, Artificial Sequence
  Peptide Derived from Human Papillomavirus
RSKPAVATSK

SEQ ID NO: 39199 - protein, 11 aa, Artificial Sequence
  Peptide Derived from Human Papillomavirus
RSKPAVATSKK

SEQ ID NO: 39200 - protein, 9 aa, Artificial Sequence
  Peptide Derived from Human Papillomavirus
RSTAITCQR

SEQ ID NO: 39201 - protein, 10 aa, Artificial Sequence
  Peptide Derived from Human Papillomavirus
RSTNMTISTA

SEQ ID NO: 39202 - protein, 8 aa, Artificial Sequence
  Peptide Derived from Human Papillomavirus
RTSIFYHA

SEQ ID NO: 39203 - protein, 9 aa, Artificial Sequence
  Peptide Derived from Human Papillomavirus
RVRLPDPNK

SEQ ID NO: 39204 - protein, 10 aa, Artificial Sequence
  Peptide Derived from Human Papillomavirus
RVRLPDPNKF

SEQ ID NO: 39205 - protein, 11 aa, Artificial Sequence
  Peptide Derived from Human Papillomavirus
SADAYGDSMWF

SEQ ID NO: 39206 - protein, 9 aa, Artificial Sequence
  Peptide Derived from Human Papillomavirus
SAEVMAYLH

SEQ ID NO: 39207 - protein, 10 aa, Artificial Sequence
  Peptide Derived from Human Papillomavirus
SAPTSTSTPA

SEQ ID NO: 39208 - protein, 11 aa, Artificial Sequence
  Peptide Derived from Human Papillomavirus
SAPTSTSTPAK

SEQ ID NO: 39209 - protein, 8 aa, Artificial Sequence
  Peptide Derived from Human Papillomavirus
SAYQYRVF

SEQ ID NO: 39210 - protein, 9 aa, Artificial Sequence
  Peptide Derived from Human Papillomavirus
SAYQYRVFR

SEQ ID NO: 39211 - protein, 11 aa, Artificial Sequence
  Peptide Derived from Human Papillomavirus
SAYQYRVFRVR

SEQ ID NO: 39212 - protein, 9 aa, Artificial Sequence
  Peptide Derived from Human Papillomavirus
SFSTDLDQF

SEQ ID NO: 39213 - protein, 8 aa, Artificial Sequence
  Peptide Derived from Human Papillomavirus
SGHPLFNR

SEQ ID NO: 39214 - protein, 9 aa, Artificial Sequence
  Peptide Derived from Human Papillomavirus
SGSMITSEA

SEQ ID NO: 39215 - protein, 10 aa, Artificial Sequence
  Peptide Derived from Human Papillomavirus
SIFYHAGSSR

SEQ ID NO: 39216 - protein, 8 aa, Artificial Sequence
  Peptide Derived from Human Papillomavirus
SLEDKYRY

SEQ ID NO: 39217 - protein, 10 aa, Artificial Sequence
  Peptide Derived from Human Papillomavirus
SLEDKYRYVR

SEQ ID NO: 39218 - protein, 10 aa, Artificial Sequence
  Peptide Derived from Human Papillomavirus
SMITSEAQLF

SEQ ID NO: 39219 - protein, 8 aa, Artificial Sequence
  Peptide Derived from Human Papillomavirus
SMWFYLRR

SEQ ID NO: 39220 - protein, 9 aa, Artificial Sequence
  Peptide Derived from Human Papillomavirus
SSRLLAVGH

SEQ ID NO: 39221 - protein, 11 aa, Artificial Sequence
  Peptide Derived from Human Papillomavirus
SSRLLAVGHPY

SEQ ID NO: 39222 - protein, 8 aa, Artificial Sequence
  Peptide Derived from Human Papillomavirus
STAITCQR

SEQ ID NO: 39223 - protein, 9 aa, Artificial Sequence
  Peptide Derived from Human Papillomavirus
STATEQLSK

SEQ ID NO: 39224 - protein, 10 aa, Artificial Sequence
  Peptide Derived from Human Papillomavirus
STATEQLSKY

SEQ ID NO: 39225 - protein, 8 aa, Artificial Sequence
  Peptide Derived from Human Papillomavirus
STCKYPDY

SEQ ID NO: 39226 - protein, 10 aa, Artificial Sequence
  Peptide Derived from Human Papillomavirus
STCKYPDYLK

SEQ ID NO: 39227 - protein, 11 aa, Artificial Sequence
  Peptide Derived from Human Papillomavirus
STDLDQFPLGR

SEQ ID NO: 39228 - protein, 9 aa, Artificial Sequence
  Peptide Derived from Human Papillomavirus
STNMTISTA

SEQ ID NO: 39229 - protein, 8 aa, Artificial Sequence
  Peptide Derived from Human Papillomavirus
STPAKRKR

SEQ ID NO: 39230 - protein, 9 aa, Artificial Sequence
  Peptide Derived from Human Papillomavirus
STPAKRKRR

SEQ ID NO: 39231 - protein, 8 aa, Artificial Sequence
  Peptide Derived from Human Papillomavirus
STSTPAKR

SEQ ID NO: 39232 - protein, 9 aa, Artificial Sequence
  Peptide Derived from Human Papillomavirus
STSTPAKRK

SEQ ID NO: 39233 - protein, 10 aa, Artificial Sequence
  Peptide Derived from Human Papillomavirus
STSTPAKRKR

SEQ ID NO: 39234 - protein, 11 aa, Artificial Sequence
  Peptide Derived from Human Papillomavirus
STSTPAKRKRR

SEQ ID NO: 39235 - protein, 8 aa, Artificial Sequence
  Peptide Derived from Human Papillomavirus
SVTKDNTK

SEQ ID NO: 39236 - protein, 8 aa, Artificial Sequence
  Peptide Derived from Human Papillomavirus
TATEQLSK

SEQ ID NO: 39237 - protein, 9 aa, Artificial Sequence
  Peptide Derived from Human Papillomavirus
TATEQLSKY

SEQ ID NO: 39238 - protein, 11 aa, Artificial Sequence
  Peptide Derived from Human Papillomavirus
TATEQLSKYDA

SEQ ID NO: 39239 - protein, 9 aa, Artificial Sequence
  Peptide Derived from Human Papillomavirus
TCKYPDYLK

SEQ ID NO: 39240 - protein, 11 aa, Artificial Sequence
  Peptide Derived from Human Papillomavirus
TCQREQPPTEK

SEQ ID NO: 39241 - protein, 10 aa, Artificial Sequence
  Peptide Derived from Human Papillomavirus
TDLDQFPLGR

SEQ ID NO: 39242 - protein, 11 aa, Artificial Sequence
  Peptide Derived from Human Papillomavirus
TDLDQFPLGRK

SEQ ID NO: 39243 - protein, 11 aa, Artificial Sequence
  Peptide Derived from Human Papillomavirus
TDSYVKRTSIF

SEQ ID NO: 39244 - protein, 8 aa, Artificial Sequence
  Peptide Derived from Human Papillomavirus
TGDCPPLA

SEQ ID NO: 39245 - protein, 8 aa, Artificial Sequence
  Peptide Derived from Human Papillomavirus
TGFGAMDF

SEQ ID NO: 39246 - protein, 9 aa, Artificial Sequence
  Peptide Derived from Human Papillomavirus
TGFGAMDFK

SEQ ID NO: 39247 - protein, 9 aa, Artificial Sequence
  Peptide Derived from Human Papillomavirus
TIPAELYLK

SEQ ID NO: 39248 - protein, 11 aa, Artificial Sequence
  Peptide Derived from Human Papillomavirus
TISTATEQLSK

SEQ ID NO: 39249 - protein, 8 aa, Artificial Sequence
  Peptide Derived from Human Papillomavirus
TLSAEVMA

SEQ ID NO: 39250 - protein, 9 aa, Artificial Sequence
  Peptide Derived from Human Papillomavirus
TLSAEVMAY

SEQ ID NO: 39251 - protein, 11 aa, Artificial Sequence
  Peptide Derived from Human Papillomavirus
TLSAEVMAYLH

SEQ ID NO: 39252 - protein, 9 aa, Artificial Sequence
  Peptide Derived from Human Papillomavirus
TSEAQLFNK

SEQ ID NO: 39253 - protein, 11 aa, Artificial Sequence
  Peptide Derived from Human Papillomavirus
TSEAQLFNKPY

SEQ ID NO: 39254 - protein, 11 aa, Artificial Sequence
  Peptide Derived from Human Papillomavirus
TSIFYHAGSSR

SEQ ID NO: 39255 - protein, 8 aa, Artificial Sequence
  Peptide Derived from Human Papillomavirus
TSLEDKYR

SEQ ID NO: 39256 - protein, 9 aa, Artificial Sequence
  Peptide Derived from Human Papillomavirus
TSLEDKYRY

SEQ ID NO: 39257 - protein, 11 aa, Artificial Sequence
  Peptide Derived from Human Papillomavirus
TSLEDKYRYVR

SEQ ID NO: 39258 - protein, 8 aa, Artificial Sequence
  Peptide Derived from Human Papillomavirus
TSTPAKRK

SEQ ID NO: 39259 - protein, 9 aa, Artificial Sequence
  Peptide Derived from Human Papillomavirus
TSTPAKRKR

SEQ ID NO: 39260 - protein, 10 aa, Artificial Sequence
  Peptide Derived from Human Papillomavirus
TSTPAKRKRR

SEQ ID NO: 39261 - protein, 8 aa, Artificial Sequence
  Peptide Derived from Human Papillomavirus
TSTSTPAK

SEQ ID NO: 39262 - protein, 9 aa, Artificial Sequence
  Peptide Derived from Human Papillomavirus
TSTSTPAKR

SEQ ID NO: 39263 - protein, 10 aa, Artificial Sequence
  Peptide Derived from Human Papillomavirus
TSTSTPAKRK

SEQ ID NO: 39264 - protein, 11 aa, Artificial Sequence
  Peptide Derived from Human Papillomavirus
TSTSTPAKRKR

SEQ ID NO: 39265 - protein, 9 aa, Artificial Sequence
  Peptide Derived from Human Papillomavirus
TTGDCPPLA

SEQ ID NO: 39266 - protein, 8 aa, Artificial Sequence
  Peptide Derived from Human Papillomavirus
VATDSYVK

SEQ ID NO: 39267 - protein, 9 aa, Artificial Sequence
  Peptide Derived from Human Papillomavirus
VATDSYVKR

SEQ ID NO: 39268 - protein, 9 aa, Artificial Sequence
  Peptide Derived from Human Papillomavirus
VATSKKRSA

SEQ ID NO: 39269 - protein, 8 aa, Artificial Sequence
  Peptide Derived from Human Papillomavirus
VATSLEDK

SEQ ID NO: 39270 - protein, 9 aa, Artificial Sequence
  Peptide Derived from Human Papillomavirus
VATSLEDKY

SEQ ID NO: 39271 - protein, 10 aa, Artificial Sequence
  Peptide Derived from Human Papillomavirus
VATSLEDKYR

SEQ ID NO: 39272 - protein, 11 aa, Artificial Sequence
  Peptide Derived from Human Papillomavirus
VATSLEDKYRY

SEQ ID NO: 39273 - protein, 9 aa, Artificial Sequence
  Peptide Derived from Human Papillomavirus
VFPIFLQMA

SEQ ID NO: 39274 - protein, 11 aa, Artificial Sequence
  Peptide Derived from Human Papillomavirus
VFQLCKITLSA

SEQ ID NO: 39275 - protein, 11 aa, Artificial Sequence
  Peptide Derived from Human Papillomavirus
VFRVRLPDPNK

SEQ ID NO: 39276 - protein, 10 aa, Artificial Sequence
  Peptide Derived from Human Papillomavirus
VGAVNVFPIF

SEQ ID NO: 39277 - protein, 10 aa, Artificial Sequence
  Peptide Derived from Human Papillomavirus
VGCTPAMGEH

SEQ ID NO: 39278 - protein, 10 aa, Artificial Sequence
  Peptide Derived from Human Papillomavirus
VGETIPAELY

SEQ ID NO: 39279 - protein, 10 aa, Artificial Sequence
  Peptide Derived from Human Papillomavirus
VGHPYYSVTK

SEQ ID NO: 39280 - protein, 9 aa, Artificial Sequence
  Peptide Derived from Human Papillomavirus
VGRGQPLGA

SEQ ID NO: 39281 - protein, 10 aa, Artificial Sequence
  Peptide Derived from Human Papillomavirus
VMAYLHNMNA

SEQ ID NO: 39282 - protein, 9 aa, Artificial Sequence
  Peptide Derived from Human Papillomavirus
VSAYQYRVF

SEQ ID NO: 39283 - protein, 10 aa, Artificial Sequence
  Peptide Derived from Human Papillomavirus
VSAYQYRVFR

SEQ ID NO: 39284 - protein, 10 aa, Artificial Sequence
  Peptide Derived from Human Papillomavirus
VSKVVATDSY

SEQ ID NO: 39285 - protein, 10 aa, Artificial Sequence
  Peptide Derived from Human Papillomavirus
VTTGDCPPLA

SEQ ID NO: 39286 - protein, 8 aa, Artificial Sequence
  Peptide Derived from Human Papillomavirus
VTVVDTTR

SEQ ID NO: 39287 - protein, 9 aa, Artificial Sequence
  Peptide Derived from Human Papillomavirus
VVATDSYVK

SEQ ID NO: 39288 - protein, 10 aa, Artificial Sequence
  Peptide Derived from Human Papillomavirus
VVATDSYVKR

SEQ ID NO: 39289 - protein, 10 aa, Artificial Sequence
  Peptide Derived from Human Papillomavirus
WACVGLEVGR

SEQ ID NO: 39290 - protein, 9 aa, Artificial Sequence
  Peptide Derived from Human Papillomavirus
WDVNLQDSF

SEQ ID NO: 39291 - protein, 10 aa, Artificial Sequence
  Peptide Derived from Human Papillomavirus
WFYLRREQLF

SEQ ID NO: 39292 - protein, 11 aa, Artificial Sequence
  Peptide Derived from Human Papillomavirus
WFYLRREQLFA

SEQ ID NO: 39293 - protein, 8 aa, Artificial Sequence
  Peptide Derived from Human Papillomavirus
WLQRAQGH

SEQ ID NO: 39294 - protein, 8 aa, Artificial Sequence
  Peptide Derived from Human Papillomavirus
WTKGAVCK

SEQ ID NO: 39295 - protein, 9 aa, Artificial Sequence
  Peptide Derived from Human Papillomavirus
YDARKINQY

SEQ ID NO: 39296 - protein, 11 aa, Artificial Sequence
  Peptide Derived from Human Papillomavirus
YDARKINQYLR

SEQ ID NO: 39297 - protein, 8 aa, Artificial Sequence
  Peptide Derived from Human Papillomavirus
YGDSMWFY

SEQ ID NO: 39298 - protein, 10 aa, Artificial Sequence
  Peptide Derived from Human Papillomavirus
YGDSMWFYLR

SEQ ID NO: 39299 - protein, 11 aa, Artificial Sequence
  Peptide Derived from Human Papillomavirus
YGDSMWFYLRR

SEQ ID NO: 39300 - protein, 11 aa, Artificial Sequence
  Peptide Derived from Human Papillomavirus
YGLCIFLDVGA

SEQ ID NO: 39301 - protein, 9 aa, Artificial Sequence
  Peptide Derived from Human Papillomavirus
YIYRDPPLH

SEQ ID NO: 39302 - protein, 10 aa, Artificial Sequence
  Peptide Derived from Human Papillomavirus
YIYRDPPLHY

SEQ ID NO: 39303 - protein, 8 aa, Artificial Sequence
  Peptide Derived from Human Papillomavirus
YLKGSNGR

SEQ ID NO: 39304 - protein, 8 aa, Artificial Sequence
  Peptide Derived from Human Papillomavirus
YLKMSADA

SEQ ID NO: 39305 - protein, 9 aa, Artificial Sequence
  Peptide Derived from Human Papillomavirus
YLKMSADAY

SEQ ID NO: 39306 - protein, 9 aa, Artificial Sequence
  Peptide Derived from Human Papillomavirus
YLPPTPVSK

SEQ ID NO: 39307 - protein, 8 aa, Artificial Sequence
  Peptide Derived from Human Papillomavirus
YLRHVEEY

SEQ ID NO: 39308 - protein, 8 aa, Artificial Sequence
  Peptide Derived from Human Papillomavirus
YLRREQLF

SEQ ID NO: 39309 - protein, 9 aa, Artificial Sequence
  Peptide Derived from Human Papillomavirus
YLRREQLFA

SEQ ID NO: 39310 - protein, 10 aa, Artificial Sequence
  Peptide Derived from Human Papillomavirus
YLRREQLFAR

SEQ ID NO: 39311 - protein, 11 aa, Artificial Sequence
  Peptide Derived from Human Papillomavirus
YLRREQLFARH

SEQ ID NO: 39312 - protein, 9 aa, Artificial Sequence
  Peptide Derived from Human Papillomavirus
YSVTKDNTK

SEQ ID NO: 39313 - protein, 8 aa, Artificial Sequence
  Peptide Derived from Human Papillomavirus
YVKRTSIF

SEQ ID NO: 39314 - protein, 9 aa, Artificial Sequence
  Peptide Derived from Human Papillomavirus
YVKRTSIFY

SEQ ID NO: 39315 - protein, 10 aa, Artificial Sequence
  Peptide Derived from Human Papillomavirus
YVKRTSIFYH

SEQ ID NO: 39316 - protein, 11 aa, Artificial Sequence
  Peptide Derived from Human Papillomavirus
YVKRTSIFYHA

SEQ ID NO: 39317 - protein, 11 aa, Artificial Sequence
  Peptide Derived from Human Papillomavirus
YVRSTAITCQR

SEQ ID NO: 39318 - protein, 8 aa, Artificial Sequence
  Peptide Derived from Human Papillomavirus
AAPRLYRK

SEQ ID NO: 39319 - protein, 9 aa, Artificial Sequence
  Peptide Derived from Human Papillomavirus
AAPRLYRKA

SEQ ID NO: 39320 - protein, 10 aa, Artificial Sequence
  Peptide Derived from Human Papillomavirus
AAPRLYRKAF

SEQ ID NO: 39321 - protein, 11 aa, Artificial Sequence
  Peptide Derived from Human Papillomavirus
ADKILQWGSLF

SEQ ID NO: 39322 - protein, 11 aa, Artificial Sequence
  Peptide Derived from Human Papillomavirus
AFQQVKVTDPA

SEQ ID NO: 39323 - protein, 8 aa, Artificial Sequence
  Peptide Derived from Human Papillomavirus
AFSPSGVA

SEQ ID NO: 39324 - protein, 10 aa, Artificial Sequence
  Peptide Derived from Human Papillomavirus
AFTTRRGGVR

SEQ ID NO: 39325 - protein, 11 aa, Artificial Sequence
  Peptide Derived from Human Papillomavirus
AFTTRRGGVRF

SEQ ID NO: 39326 - protein, 9 aa, Artificial Sequence
  Peptide Derived from Human Papillomavirus
AGYVPLGSR

SEQ ID NO: 39327 - protein, 10 aa, Artificial Sequence
  Peptide Derived from Human Papillomavirus
ALHRPAFTTR

SEQ ID NO: 39328 - protein, 11 aa, Artificial Sequence
  Peptide Derived from Human Papillomavirus
ALHRPAFTTRR

SEQ ID NO: 39329 - protein, 8 aa, Artificial Sequence
  Peptide Derived from Human Papillomavirus
ALWPVYFF

SEQ ID NO: 39330 - protein, 9 aa, Artificial Sequence
  Peptide Derived from Human Papillomavirus
ALWPVYFFR

SEQ ID NO: 39331 - protein, 10 aa, Artificial Sequence
  Peptide Derived from Human Papillomavirus
ALWPVYFFRR

SEQ ID NO: 39332 - protein, 11 aa, Artificial Sequence
  Peptide Derived from Human Papillomavirus
ALWPVYFFRRR

SEQ ID NO: 39333 - protein, 8 aa, Artificial Sequence
  Peptide Derived from Human Papillomavirus
ASATQLYK

SEQ ID NO: 39334 - protein, 11 aa, Artificial Sequence
  Peptide Derived from Human Papillomavirus
ASATQLYKTCK

SEQ ID NO: 39335 - protein, 9 aa, Artificial Sequence
  Peptide Derived from Human Papillomavirus
ASNTTNVTA

SEQ ID NO: 39336 - protein, 11 aa, Artificial Sequence
  Peptide Derived from Human Papillomavirus
ATLVSADNPLF

SEQ ID NO: 39337 - protein, 10 aa, Artificial Sequence
  Peptide Derived from Human Papillomavirus
ATPSAHLPIK

SEQ ID NO: 39338 - protein, 9 aa, Artificial Sequence
  Peptide Derived from Human Papillomavirus
ATQLYKTCK

SEQ ID NO: 39339 - protein, 9 aa, Artificial Sequence
  Peptide Derived from Human Papillomavirus
ATRRKRASA

SEQ ID NO: 39340 - protein, 9 aa, Artificial Sequence
  Peptide Derived from Human Papillomavirus
DFMNIVALH

SEQ ID NO: 39341 - protein, 10 aa, Artificial Sequence
  Peptide Derived from Human Papillomavirus
DFMNIVALHR

SEQ ID NO: 39342 - protein, 8 aa, Artificial Sequence
  Peptide Derived from Human Papillomavirus
DGLYDIYA

SEQ ID NO: 39343 - protein, 8 aa, Artificial Sequence
  Peptide Derived from Human Papillomavirus
DISPIAQA

SEQ ID NO: 39344 - protein, 10 aa, Artificial Sequence
  Peptide Derived from Human Papillomavirus
DITPTSSTVH

SEQ ID NO: 39345 - protein, 10 aa, Artificial Sequence
  Peptide Derived from Human Papillomavirus
DIYANIDDEA

SEQ ID NO: 39346 - protein, 9 aa, Artificial Sequence
  Peptide Derived from Human Papillomavirus
DVVNKIEQK

SEQ ID NO: 39347 - protein, 9 aa, Artificial Sequence
  Peptide Derived from Human Papillomavirus
DVYIQGSSF

SEQ ID NO: 39348 - protein, 10 aa, Artificial Sequence
  Peptide Derived from Human Papillomavirus
DVYIQGSSFA

SEQ ID NO: 39349 - protein, 11 aa, Artificial Sequence
  Peptide Derived from Human Papillomavirus
EAPGLSSQSVA

SEQ ID NO: 39350 - protein, 10 aa, Artificial Sequence
  Peptide Derived from Human Papillomavirus
EDVVNKIEQK

SEQ ID NO: 39351 - protein, 8 aa, Artificial Sequence
  Peptide Derived from Human Papillomavirus
EGTDTSLA

SEQ ID NO: 39352 - protein, 9 aa, Artificial Sequence
  Peptide Derived from Human Papillomavirus
EGTDTSLAF

SEQ ID NO: 39353 - protein, 10 aa, Artificial Sequence
  Peptide Derived from Human Papillomavirus
EIEMQPLLSA

SEQ ID NO: 39354 - protein, 8 aa, Artificial Sequence
  Peptide Derived from Human Papillomavirus
EIPMQTFA

SEQ ID NO: 39355 - protein, 10 aa, Artificial Sequence
  Peptide Derived from Human Papillomavirus
EIPMQTFAVH

SEQ ID NO: 39356 - protein, 11 aa, Artificial Sequence
  Peptide Derived from Human Papillomavirus
EITSSSTTTPA

SEQ ID NO: 39357 - protein, 8 aa, Artificial Sequence
  Peptide Derived from Human Papillomavirus
EMQPLLSA

SEQ ID NO: 39358 - protein, 9 aa, Artificial Sequence
  Peptide Derived from Human Papillomavirus
ESGAGIPNF

SEQ ID NO: 39359 - protein, 9 aa, Artificial Sequence
  Peptide Derived from Human Papillomavirus
ESSVIESGA

SEQ ID NO: 39360 - protein, 8 aa, Artificial Sequence
  Peptide Derived from Human Papillomavirus
FADGDVAA

SEQ ID NO: 39361 - protein, 8 aa, Artificial Sequence
  Peptide Derived from Human Papillomavirus
FALWPVYF

SEQ ID NO: 39362 - protein, 9 aa, Artificial Sequence
  Peptide Derived from Human Papillomavirus
FALWPVYFF

SEQ ID NO: 39363 - protein, 10 aa, Artificial Sequence
  Peptide Derived from Human Papillomavirus
FALWPVYFFR

SEQ ID NO: 39364 - protein, 11 aa, Artificial Sequence
  Peptide Derived from Human Papillomavirus
FALWPVYFFRR

SEQ ID NO: 39365 - protein, 10 aa, Artificial Sequence
  Peptide Derived from Human Papillomavirus
FASNTTNVTA

SEQ ID NO: 39366 - protein, 8 aa, Artificial Sequence
  Peptide Derived from Human Papillomavirus
FDGLYDIY

SEQ ID NO: 39367 - protein, 9 aa, Artificial Sequence
  Peptide Derived from Human Papillomavirus
FDGLYDIYA

SEQ ID NO: 39368 - protein, 8 aa, Artificial Sequence
  Peptide Derived from Human Papillomavirus
FFADGDVA

SEQ ID NO: 39369 - protein, 9 aa, Artificial Sequence
  Peptide Derived from Human Papillomavirus
FFADGDVAA

SEQ ID NO: 39370 - protein, 8 aa, Artificial Sequence
  Peptide Derived from Human Papillomavirus
FFRRRRRK

SEQ ID NO: 39371 - protein, 9 aa, Artificial Sequence
  Peptide Derived from Human Papillomavirus
FFRRRRRKR

SEQ ID NO: 39372 - protein, 9 aa, Artificial Sequence
  Peptide Derived from Human Papillomavirus
FIDPPVIEA

SEQ ID NO: 39373 - protein, 11 aa, Artificial Sequence
  Peptide Derived from Human Papillomavirus
FLDRPATLVSA

SEQ ID NO: 39374 - protein, 8 aa, Artificial Sequence
  Peptide Derived from Human Papillomavirus
FMNIVALH

SEQ ID NO: 39375 - protein, 9 aa, Artificial Sequence
  Peptide Derived from Human Papillomavirus
FMNIVALHR

SEQ ID NO: 39376 - protein, 11 aa, Artificial Sequence
  Peptide Derived from Human Papillomavirus
FMNIVALHRPA

SEQ ID NO: 39377 - protein, 8 aa, Artificial Sequence
  Peptide Derived from Human Papillomavirus
FSRLGRKA

SEQ ID NO: 39378 - protein, 9 aa, Artificial Sequence
  Peptide Derived from Human Papillomavirus
FTTRRGGVR

SEQ ID NO: 39379 - protein, 10 aa, Artificial Sequence
  Peptide Derived from Human Papillomavirus
FTTRRGGVRF

SEQ ID NO: 39380 - protein, 11 aa, Artificial Sequence
  Peptide Derived from Human Papillomavirus
FVPQSPYDVTH

SEQ ID NO: 39381 - protein, 8 aa, Artificial Sequence
  Peptide Derived from Human Papillomavirus
GARVHYYY

SEQ ID NO: 39382 - protein, 9 aa, Artificial Sequence
  Peptide Derived from Human Papillomavirus
GFRRIAAPR

SEQ ID NO: 39383 - protein, 11 aa, Artificial Sequence
  Peptide Derived from Human Papillomavirus
GFRRIAAPRLY

SEQ ID NO: 39384 - protein, 10 aa, Artificial Sequence
  Peptide Derived from Human Papillomavirus
GGVRFSRLGR

SEQ ID NO: 39385 - protein, 11 aa, Artificial Sequence
  Peptide Derived from Human Papillomavirus
GGVRFSRLGRK

SEQ ID NO: 39386 - protein, 11 aa, Artificial Sequence
  Peptide Derived from Human Papillomavirus
GIGTGTGSGGR

SEQ ID NO: 39387 - protein, 11 aa, Artificial Sequence
  Peptide Derived from Human Papillomavirus
GIPNFTGSGGF

SEQ ID NO: 39388 - protein, 8 aa, Artificial Sequence
  Peptide Derived from Human Papillomavirus
GLSSQSVA

SEQ ID NO: 39389 - protein, 8 aa, Artificial Sequence
  Peptide Derived from Human Papillomavirus
GSGGRAGY

SEQ ID NO: 39390 - protein, 10 aa, Artificial Sequence
  Peptide Derived from Human Papillomavirus
GSSFALWPVY

SEQ ID NO: 39391 - protein, 11 aa, Artificial Sequence
  Peptide Derived from Human Papillomavirus
GSSFALWPVYF

SEQ ID NO: 39392 - protein, 10 aa, Artificial Sequence
  Peptide Derived from Human Papillomavirus
GTCPEDVVNK

SEQ ID NO: 39393 - protein, 8 aa, Artificial Sequence
  Peptide Derived from Human Papillomavirus
GTDTSLAF

SEQ ID NO: 39394 - protein, 8 aa, Artificial Sequence
  Peptide Derived from Human Papillomavirus
GTGSGGRA

SEQ ID NO: 39395 - protein, 10 aa, Artificial Sequence
  Peptide Derived from Human Papillomavirus
GTGSGGRAGY

SEQ ID NO: 39396 - protein, 9 aa, Artificial Sequence
  Peptide Derived from Human Papillomavirus
GTGTGSGGR

SEQ ID NO: 39397 - protein, 10 aa, Artificial Sequence
  Peptide Derived from Human Papillomavirus
GTGTGSGGRA

SEQ ID NO: 39398 - protein, 9 aa, Artificial Sequence
  Peptide Derived from Human Papillomavirus
GTQIGARVH

SEQ ID NO: 39399 - protein, 10 aa, Artificial Sequence
  Peptide Derived from Human Papillomavirus
GTQIGARVHY

SEQ ID NO: 39400 - protein, 11 aa, Artificial Sequence
  Peptide Derived from Human Papillomavirus
GTQIGARVHYY

SEQ ID NO: 39401 - protein, 8 aa, Artificial Sequence
  Peptide Derived from Human Papillomavirus
GVAPDPDF

SEQ ID NO: 39402 - protein, 9 aa, Artificial Sequence
  Peptide Derived from Human Papillomavirus
GVRFSRLGR

SEQ ID NO: 39403 - protein, 10 aa, Artificial Sequence
  Peptide Derived from Human Papillomavirus
GVRFSRLGRK

SEQ ID NO: 39404 - protein, 11 aa, Artificial Sequence
  Peptide Derived from Human Papillomavirus
GVRFSRLGRKA

SEQ ID NO: 39405 - protein, 10 aa, Artificial Sequence
  Peptide Derived from Human Papillomavirus
HDVYIQGSSF

SEQ ID NO: 39406 - protein, 11 aa, Artificial Sequence
  Peptide Derived from Human Papillomavirus
HDVYIQGSSFA

SEQ ID NO: 39407 - protein, 11 aa, Artificial Sequence
  Peptide Derived from Human Papillomavirus
HLPIKPSTLSF

SEQ ID NO: 39408 - protein, 11 aa, Artificial Sequence
  Peptide Derived from Human Papillomavirus
HSYEEIPMQTF

SEQ ID NO: 39409 - protein, 8 aa, Artificial Sequence
  Peptide Derived from Human Papillomavirus
IAAPRLYR

SEQ ID NO: 39410 - protein, 9 aa, Artificial Sequence
  Peptide Derived from Human Papillomavirus
IAAPRLYRK

SEQ ID NO: 39411 - protein, 10 aa, Artificial Sequence
  Peptide Derived from Human Papillomavirus
IAAPRLYRKA

SEQ ID NO: 39412 - protein, 11 aa, Artificial Sequence
  Peptide Derived from Human Papillomavirus
IAAPRLYRKAF

SEQ ID NO: 39413 - protein, 8 aa, Artificial Sequence
  Peptide Derived from Human Papillomavirus
IDPPVIEA

SEQ ID NO: 39414 - protein, 8 aa, Artificial Sequence
  Peptide Derived from Human Papillomavirus
IGARVHYY

SEQ ID NO: 39415 - protein, 9 aa, Artificial Sequence
  Peptide Derived from Human Papillomavirus
IGARVHYYY

SEQ ID NO: 39416 - protein, 10 aa, Artificial Sequence
  Peptide Derived from Human Papillomavirus
IGTGTGSGGR

SEQ ID NO: 39417 - protein, 11 aa, Artificial Sequence
  Peptide Derived from Human Papillomavirus
IGTGTGSGGRA

SEQ ID NO: 39418 - protein, 11 aa, Artificial Sequence
  Peptide Derived from Human Papillomavirus
ILISTPTSGIH

SEQ ID NO: 39419 - protein, 8 aa, Artificial Sequence
  Peptide Derived from Human Papillomavirus
ILQWGSLF

SEQ ID NO: 39420 - protein, 10 aa, Artificial Sequence
  Peptide Derived from Human Papillomavirus
ILQWGSLFTY

SEQ ID NO: 39421 - protein, 11 aa, Artificial Sequence
  Peptide Derived from Human Papillomavirus
ILQWGSLFTYF

SEQ ID NO: 39422 - protein, 9 aa, Artificial Sequence
  Peptide Derived from Human Papillomavirus
ISSTPIPGF

SEQ ID NO: 39423 - protein, 10 aa, Artificial Sequence
  Peptide Derived from Human Papillomavirus
ISSTPIPGFR

SEQ ID NO: 39424 - protein, 11 aa, Artificial Sequence
  Peptide Derived from Human Papillomavirus
ISSTPIPGFRR

SEQ ID NO: 39425 - protein, 9 aa, Artificial Sequence
  Peptide Derived from Human Papillomavirus
ISTPTSGIH

SEQ ID NO: 39426 - protein, 11 aa, Artificial Sequence
  Peptide Derived from Human Papillomavirus
ISTPTSGIHSY

SEQ ID NO: 39427 - protein, 9 aa, Artificial Sequence
  Peptide Derived from Human Papillomavirus
ITPTSSTVH

SEQ ID NO: 39428 - protein, 10 aa, Artificial Sequence
  Peptide Derived from Human Papillomavirus
ITSSSTTTPA

SEQ ID NO: 39429 - protein, 8 aa, Artificial Sequence
  Peptide Derived from Human Papillomavirus
IVALHRPA

SEQ ID NO: 39430 - protein, 9 aa, Artificial Sequence
  Peptide Derived from Human Papillomavirus
IVALHRPAF

SEQ ID NO: 39431 - protein, 8 aa, Artificial Sequence
  Peptide Derived from Human Papillomavirus
IVDVTPAR

SEQ ID NO: 39432 - protein, 8 aa, Artificial Sequence
  Peptide Derived from Human Papillomavirus
KATIQTRR

SEQ ID NO: 39433 - protein, 8 aa, Artificial Sequence
  Peptide Derived from Human Papillomavirus
KIEQKTWA

SEQ ID NO: 39434 - protein, 10 aa, Artificial Sequence
  Peptide Derived from Human Papillomavirus
KIEQKTWADK

SEQ ID NO: 39435 - protein, 9 aa, Artificial Sequence
  Peptide Derived from Human Papillomavirus
KILQWGSLF

SEQ ID NO: 39436 - protein, 11 aa, Artificial Sequence
  Peptide Derived from Human Papillomavirus
KILQWGSLFTY

SEQ ID NO: 39437 - protein, 10 aa, Artificial Sequence
  Peptide Derived from Human Papillomavirus
KVTDPAFLDR

SEQ ID NO: 39438 - protein, 9 aa, Artificial Sequence
  Peptide Derived from Human Papillomavirus
LAFSPSGVA

SEQ ID NO: 39439 - protein, 11 aa, Artificial Sequence
  Peptide Derived from Human Papillomavirus
LDITPTSSTVH

SEQ ID NO: 39440 - protein, 10 aa, Artificial Sequence
  Peptide Derived from Human Papillomavirus
LDRPATLVSA

SEQ ID NO: 39441 - protein, 10 aa, Artificial Sequence
  Peptide Derived from Human Papillomavirus
LFEGTDTSLA

SEQ ID NO: 39442 - protein, 11 aa, Artificial Sequence
  Peptide Derived from Human Papillomavirus
LFEGTDTSLAF

SEQ ID NO: 39443 - protein, 10 aa, Artificial Sequence
  Peptide Derived from Human Papillomavirus
LFIDPPVIEA

SEQ ID NO: 39444 - protein, 9 aa, Artificial Sequence
  Peptide Derived from Human Papillomavirus
LGNVWETPF

SEQ ID NO: 39445 - protein, 10 aa, Artificial Sequence
  Peptide Derived from Human Papillomavirus
LGNVWETPFY

SEQ ID NO: 39446 - protein, 10 aa, Artificial Sequence
  Peptide Derived from Human Papillomavirus
LGRKATIQTR

SEQ ID NO: 39447 - protein, 11 aa, Artificial Sequence
  Peptide Derived from Human Papillomavirus
LGRKATIQTRR

SEQ ID NO: 39448 - protein, 10 aa, Artificial Sequence
  Peptide Derived from Human Papillomavirus
LISTPTSGIH

SEQ ID NO: 39449 - protein, 8 aa, Artificial Sequence
  Peptide Derived from Human Papillomavirus
LLSANNSF

SEQ ID NO: 39450 - protein, 11 aa, Artificial Sequence
  Peptide Derived from Human Papillomavirus
LSANNSFDGLY

SEQ ID NO: 39451 - protein, 11 aa, Artificial Sequence
  Peptide Derived from Human Papillomavirus
LSSQSVATPSA

SEQ ID NO: 39452 - protein, 9 aa, Artificial Sequence
  Peptide Derived from Human Papillomavirus
LVSADNPLF

SEQ ID NO: 39453 - protein, 8 aa, Artificial Sequence
  Peptide Derived from Human Papillomavirus
MVAHRATR

SEQ ID NO: 39454 - protein, 9 aa, Artificial Sequence
  Peptide Derived from Human Papillomavirus
MVAHRATRR

SEQ ID NO: 39455 - protein, 10 aa, Artificial Sequence
  Peptide Derived from Human Papillomavirus
MVAHRATRRK

SEQ ID NO: 39456 - protein, 11 aa, Artificial Sequence
  Peptide Derived from Human Papillomavirus
MVAHRATRRKR

SEQ ID NO: 39457 - protein, 8 aa, Artificial Sequence
  Peptide Derived from Human Papillomavirus
NFTGSGGF

SEQ ID NO: 39458 - protein, 9 aa, Artificial Sequence
  Peptide Derived from Human Papillomavirus
NIVALHRPA

SEQ ID NO: 39459 - protein, 10 aa, Artificial Sequence
  Peptide Derived from Human Papillomavirus
NIVALHRPAF

SEQ ID NO: 39460 - protein, 10 aa, Artificial Sequence
  Peptide Derived from Human Papillomavirus
NSFDGLYDIY

SEQ ID NO: 39461 - protein, 11 aa, Artificial Sequence
  Peptide Derived from Human Papillomavirus
NSFDGLYDIYA

SEQ ID NO: 39462 - protein, 8 aa, Artificial Sequence
  Peptide Derived from Human Papillomavirus
NVWETPFY

SEQ ID NO: 39463 - protein, 8 aa, Artificial Sequence
  Peptide Derived from Human Papillomavirus
PAFLDRPA

SEQ ID NO: 39464 - protein, 11 aa, Artificial Sequence
  Peptide Derived from Human Papillomavirus
PAFTTRRGGVR

SEQ ID NO: 39465 - protein, 8 aa, Artificial Sequence
  Peptide Derived from Human Papillomavirus
PDFMNIVA

SEQ ID NO: 39466 - protein, 10 aa, Artificial Sequence
  Peptide Derived from Human Papillomavirus
PDFMNIVALH

SEQ ID NO: 39467 - protein, 11 aa, Artificial Sequence
  Peptide Derived from Human Papillomavirus
PDFMNIVALHR

SEQ ID NO: 39468 - protein, 10 aa, Artificial Sequence
  Peptide Derived from Human Papillomavirus
PDPDFMNIVA

SEQ ID NO: 39469 - protein, 8 aa, Artificial Sequence
  Peptide Derived from Human Papillomavirus
PFVPQSPY

SEQ ID NO: 39470 - protein, 8 aa, Artificial Sequence
  Peptide Derived from Human Papillomavirus
PGFRRIAA

SEQ ID NO: 39471 - protein, 10 aa, Artificial Sequence
  Peptide Derived from Human Papillomavirus
PGFRRIAAPR

SEQ ID NO: 39472 - protein, 9 aa, Artificial Sequence
  Peptide Derived from Human Papillomavirus
PGLSSQSVA

SEQ ID NO: 39473 - protein, 9 aa, Artificial Sequence
  Peptide Derived from Human Papillomavirus
PIKPSTLSF

SEQ ID NO: 39474 - protein, 10 aa, Artificial Sequence
  Peptide Derived from Human Papillomavirus
PIKPSTLSFA

SEQ ID NO: 39475 - protein, 9 aa, Artificial Sequence
  Peptide Derived from Human Papillomavirus
PIPGFRRIA

SEQ ID NO: 39476 - protein, 10 aa, Artificial Sequence
  Peptide Derived from Human Papillomavirus
PIPGFRRIAA

SEQ ID NO: 39477 - protein, 10 aa, Artificial Sequence
  Peptide Derived from Human Papillomavirus
PISSTPIPGF

SEQ ID NO: 39478 - protein, 11 aa, Artificial Sequence
  Peptide Derived from Human Papillomavirus
PISSTPIPGFR

SEQ ID NO: 39479 - protein, 11 aa, Artificial Sequence
  Peptide Derived from Human Papillomavirus
PLFEGTDTSLA

SEQ ID NO: 39480 - protein, 11 aa, Artificial Sequence
  Peptide Derived from Human Papillomavirus
PLFIDPPVIEA

SEQ ID NO: 39481 - protein, 10 aa, Artificial Sequence
  Peptide Derived from Human Papillomavirus
PLGNVWETPF

SEQ ID NO: 39482 - protein, 11 aa, Artificial Sequence
  Peptide Derived from Human Papillomavirus
PLGNVWETPFY

SEQ ID NO: 39483 - protein, 9 aa, Artificial Sequence
  Peptide Derived from Human Papillomavirus
PLLSANNSF

SEQ ID NO: 39484 - protein, 8 aa, Artificial Sequence
  Peptide Derived from Human Papillomavirus
PMQTFAVH

SEQ ID NO: 39485 - protein, 8 aa, Artificial Sequence
  Peptide Derived from Human Papillomavirus
PSAHLPIK

SEQ ID NO: 39486 - protein, 10 aa, Artificial Sequence
  Peptide Derived from Human Papillomavirus
PSGVAPDPDF

SEQ ID NO: 39487 - protein, 10 aa, Artificial Sequence
  Peptide Derived from Human Papillomavirus
PSTIVDVTPA

SEQ ID NO: 39488 - protein, 11 aa, Artificial Sequence
  Peptide Derived from Human Papillomavirus
PSTIVDVTPAR

SEQ ID NO: 39489 - protein, 9 aa, Artificial Sequence
  Peptide Derived from Human Papillomavirus
PTGPSTWPF

SEQ ID NO: 39490 - protein, 8 aa, Artificial Sequence
  Peptide Derived from Human Papillomavirus
PTSGIHSY

SEQ ID NO: 39491 - protein, 8 aa, Artificial Sequence
  Peptide Derived from Human Papillomavirus
PVYFFRRR

SEQ ID NO: 39492 - protein, 9 aa, Artificial Sequence
  Peptide Derived from Human Papillomavirus
PVYFFRRRR

SEQ ID NO: 39493 - protein, 10 aa, Artificial Sequence
  Peptide Derived from Human Papillomavirus
PVYFFRRRRR

SEQ ID NO: 39494 - protein, 11 aa, Artificial Sequence
  Peptide Derived from Human Papillomavirus
PVYFFRRRRRK

SEQ ID NO: 39495 - protein, 11 aa, Artificial Sequence
  Peptide Derived from Human Papillomavirus
QGSSFALWPVY

SEQ ID NO: 39496 - protein, 8 aa, Artificial Sequence
  Peptide Derived from Human Papillomavirus
QIGARVHY

SEQ ID NO: 39497 - protein, 9 aa, Artificial Sequence
  Peptide Derived from Human Papillomavirus
QIGARVHYY

SEQ ID NO: 39498 - protein, 10 aa, Artificial Sequence
  Peptide Derived from Human Papillomavirus
QIGARVHYYY

SEQ ID NO: 39499 - protein, 8 aa, Artificial Sequence
  Peptide Derived from Human Papillomavirus
QSPYDVTH

SEQ ID NO: 39500 - protein, 11 aa, Artificial Sequence
  Peptide Derived from Human Papillomavirus
QSPYDVTHDVY

SEQ ID NO: 39501 - protein, 8 aa, Artificial Sequence
  Peptide Derived from Human Papillomavirus
QSVATPSA

SEQ ID NO: 39502 - protein, 9 aa, Artificial Sequence
  Peptide Derived from Human Papillomavirus
QSVATPSAH

SEQ ID NO: 39503 - protein, 10 aa, Artificial Sequence
  Peptide Derived from Human Papillomavirus
QTRRGTQIGA

SEQ ID NO: 39504 - protein, 11 aa, Artificial Sequence
  Peptide Derived from Human Papillomavirus
QTRRGTQIGAR

SEQ ID NO: 39505 - protein, 8 aa, Artificial Sequence
  Peptide Derived from Human Papillomavirus
QVKVTDPA

SEQ ID NO: 39506 - protein, 9 aa, Artificial Sequence
  Peptide Derived from Human Papillomavirus
QVKVTDPAF

SEQ ID NO: 39507 - protein, 10 aa, Artificial Sequence
  Peptide Derived from Human Papillomavirus
RAGYVPLGSR

SEQ ID NO: 39508 - protein, 8 aa, Artificial Sequence
  Peptide Derived from Human Papillomavirus
RASATQLY

SEQ ID NO: 39509 - protein, 9 aa, Artificial Sequence
  Peptide Derived from Human Papillomavirus
RASATQLYK

SEQ ID NO: 39510 - protein, 8 aa, Artificial Sequence
  Peptide Derived from Human Papillomavirus
RATRRKRA

SEQ ID NO: 39511 - protein, 10 aa, Artificial Sequence
  Peptide Derived from Human Papillomavirus
RATRRKRASA

SEQ ID NO: 39512 - protein, 8 aa, Artificial Sequence
  Peptide Derived from Human Papillomavirus
RFSRLGRK

SEQ ID NO: 39513 - protein, 9 aa, Artificial Sequence
  Peptide Derived from Human Papillomavirus
RFSRLGRKA

SEQ ID NO: 39514 - protein, 8 aa, Artificial Sequence
  Peptide Derived from Human Papillomavirus
RGGVRFSR

SEQ ID NO: 39515 - protein, 11 aa, Artificial Sequence
  Peptide Derived from Human Papillomavirus
RGGVRFSRLGR

SEQ ID NO: 39516 - protein, 8 aa, Artificial Sequence
  Peptide Derived from Human Papillomavirus
RGTQIGAR

SEQ ID NO: 39517 - protein, 10 aa, Artificial Sequence
  Peptide Derived from Human Papillomavirus
RGTQIGARVH

SEQ ID NO: 39518 - protein, 11 aa, Artificial Sequence
  Peptide Derived from Human Papillomavirus
RGTQIGARVHY

SEQ ID NO: 39519 - protein, 8 aa, Artificial Sequence
  Peptide Derived from Human Papillomavirus
RIAAPRLY

SEQ ID NO: 39520 - protein, 9 aa, Artificial Sequence
  Peptide Derived from Human Papillomavirus
RIAAPRLYR

SEQ ID NO: 39521 - protein, 10 aa, Artificial Sequence
  Peptide Derived from Human Papillomavirus
RIAAPRLYRK

SEQ ID NO: 39522 - protein, 11 aa, Artificial Sequence
  Peptide Derived from Human Papillomavirus
RIAAPRLYRKA

SEQ ID NO: 39523 - protein, 11 aa, Artificial Sequence
  Peptide Derived from Human Papillomavirus
RLGRKATIQTR

SEQ ID NO: 39524 - protein, 11 aa, Artificial Sequence
  Peptide Derived from Human Papillomavirus
RLYRKAFQQVK

SEQ ID NO: 39525 - protein, 10 aa, Artificial Sequence
  Peptide Derived from Human Papillomavirus
SANNSFDGLY

SEQ ID NO: 39526 - protein, 10 aa, Artificial Sequence
  Peptide Derived from Human Papillomavirus
SATQLYKTCK

SEQ ID NO: 39527 - protein, 8 aa, Artificial Sequence
  Peptide Derived from Human Papillomavirus
SFALWPVY

SEQ ID NO: 39528 - protein, 9 aa, Artificial Sequence
  Peptide Derived from Human Papillomavirus
SFALWPVYF

SEQ ID NO: 39529 - protein, 10 aa, Artificial Sequence
  Peptide Derived from Human Papillomavirus
SFALWPVYFF

SEQ ID NO: 39530 - protein, 11 aa, Artificial Sequence
  Peptide Derived from Human Papillomavirus
SFALWPVYFFR

SEQ ID NO: 39531 - protein, 11 aa, Artificial Sequence
  Peptide Derived from Human Papillomavirus
SFASNTTNVTA

SEQ ID NO: 39532 - protein, 9 aa, Artificial Sequence
  Peptide Derived from Human Papillomavirus
SFDGLYDIY

SEQ ID NO: 39533 - protein, 10 aa, Artificial Sequence
  Peptide Derived from Human Papillomavirus
SFDGLYDIYA

SEQ ID NO: 39534 - protein, 8 aa, Artificial Sequence
  Peptide Derived from Human Papillomavirus
SGAGIPNF

SEQ ID NO: 39535 - protein, 11 aa, Artificial Sequence
  Peptide Derived from Human Papillomavirus
SGTCPEDVVNK

SEQ ID NO: 39536 - protein, 9 aa, Artificial Sequence
  Peptide Derived from Human Papillomavirus
SGVAPDPDF

SEQ ID NO: 39537 - protein, 10 aa, Artificial Sequence
  Peptide Derived from Human Papillomavirus
SLAFSPSGVA

SEQ ID NO: 39538 - protein, 9 aa, Artificial Sequence
  Peptide Derived from Human Papillomavirus
SSFALWPVY

SEQ ID NO: 39539 - protein, 10 aa, Artificial Sequence
  Peptide Derived from Human Papillomavirus
SSFALWPVYF

SEQ ID NO: 39540 - protein, 11 aa, Artificial Sequence
  Peptide Derived from Human Papillomavirus
SSFALWPVYFF

SEQ ID NO: 39541 - protein, 10 aa, Artificial Sequence
  Peptide Derived from Human Papillomavirus
SSQSVATPSA

SEQ ID NO: 39542 - protein, 11 aa, Artificial Sequence
  Peptide Derived from Human Papillomavirus
SSQSVATPSAH

SEQ ID NO: 39543 - protein, 8 aa, Artificial Sequence
  Peptide Derived from Human Papillomavirus
SSSTTTPA

SEQ ID NO: 39544 - protein, 10 aa, Artificial Sequence
  Peptide Derived from Human Papillomavirus
SSTHITNPLF

SEQ ID NO: 39545 - protein, 8 aa, Artificial Sequence
  Peptide Derived from Human Papillomavirus
SSTPIPGF

SEQ ID NO: 39546 - protein, 9 aa, Artificial Sequence
  Peptide Derived from Human Papillomavirus
SSTPIPGFR

SEQ ID NO: 39547 - protein, 10 aa, Artificial Sequence
  Peptide Derived from Human Papillomavirus
SSTPIPGFRR

SEQ ID NO: 39548 - protein, 10 aa, Artificial Sequence
  Peptide Derived from Human Papillomavirus
SSTVHVSSTH

SEQ ID NO: 39549 - protein, 8 aa, Artificial Sequence
  Peptide Derived from Human Papillomavirus
SSVIESGA

SEQ ID NO: 39550 - protein, 9 aa, Artificial Sequence
  Peptide Derived from Human Papillomavirus
STHITNPLF

SEQ ID NO: 39551 - protein, 9 aa, Artificial Sequence
  Peptide Derived from Human Papillomavirus
STIVDVTPA

SEQ ID NO: 39552 - protein, 10 aa, Artificial Sequence
  Peptide Derived from Human Papillomavirus
STIVDVTPAR

SEQ ID NO: 39553 - protein, 8 aa, Artificial Sequence
  Peptide Derived from Human Papillomavirus
STPIPGFR

SEQ ID NO: 39554 - protein, 9 aa, Artificial Sequence
  Peptide Derived from Human Papillomavirus
STPIPGFRR

SEQ ID NO: 39555 - protein, 11 aa, Artificial Sequence
  Peptide Derived from Human Papillomavirus
STPIPGFRRIA

SEQ ID NO: 39556 - protein, 8 aa, Artificial Sequence
  Peptide Derived from Human Papillomavirus
STPTSGIH

SEQ ID NO: 39557 - protein, 10 aa, Artificial Sequence
  Peptide Derived from Human Papillomavirus
STPTSGIHSY

SEQ ID NO: 39558 - protein, 9 aa, Artificial Sequence
  Peptide Derived from Human Papillomavirus
STVHVSSTH

SEQ ID NO: 39559 - protein, 11 aa, Artificial Sequence
  Peptide Derived from Human Papillomavirus
STWPFVPQSPY

SEQ ID NO: 39560 - protein, 8 aa, Artificial Sequence
  Peptide Derived from Human Papillomavirus
SVATPSAH

SEQ ID NO: 39561 - protein, 9 aa, Artificial Sequence
  Peptide Derived from Human Papillomavirus
TCPEDVVNK

SEQ ID NO: 39562 - protein, 8 aa, Artificial Sequence
  Peptide Derived from Human Papillomavirus
TDPAFLDR

SEQ ID NO: 39563 - protein, 10 aa, Artificial Sequence
  Peptide Derived from Human Papillomavirus
TDPAFLDRPA

SEQ ID NO: 39564 - protein, 8 aa, Artificial Sequence
  Peptide Derived from Human Papillomavirus
TGPSTWPF

SEQ ID NO: 39565 - protein, 9 aa, Artificial Sequence
  Peptide Derived from Human Papillomavirus
TGSGGRAGY

SEQ ID NO: 39566 - protein, 8 aa, Artificial Sequence
  Peptide Derived from Human Papillomavirus
TGTGSGGR

SEQ ID NO: 39567 - protein, 9 aa, Artificial Sequence
  Peptide Derived from Human Papillomavirus
TGTGSGGRA

SEQ ID NO: 39568 - protein, 11 aa, Artificial Sequence
  Peptide Derived from Human Papillomavirus
TGTGSGGRAGY

SEQ ID NO: 39569 - protein, 8 aa, Artificial Sequence
  Peptide Derived from Human Papillomavirus
TIVDVTPA

SEQ ID NO: 39570 - protein, 9 aa, Artificial Sequence
  Peptide Derived from Human Papillomavirus
TIVDVTPAR

SEQ ID NO: 39571 - protein, 10 aa, Artificial Sequence
  Peptide Derived from Human Papillomavirus
TLVSADNPLF

SEQ ID NO: 39572 - protein, 11 aa, Artificial Sequence
  Peptide Derived from Human Papillomavirus
TSLAFSPSGVA

SEQ ID NO: 39573 - protein, 9 aa, Artificial Sequence
  Peptide Derived from Human Papillomavirus
TSSSTTTPA

SEQ ID NO: 39574 - protein, 11 aa, Artificial Sequence
  Peptide Derived from Human Papillomavirus
TSSTVHVSSTH

SEQ ID NO: 39575 - protein, 8 aa, Artificial Sequence
  Peptide Derived from Human Papillomavirus
TTRRGGVR

SEQ ID NO: 39576 - protein, 9 aa, Artificial Sequence
  Peptide Derived from Human Papillomavirus
TTRRGGVRF

SEQ ID NO: 39577 - protein, 11 aa, Artificial Sequence
  Peptide Derived from Human Papillomavirus
TTRRGGVRFSR

SEQ ID NO: 39578 - protein, 8 aa, Artificial Sequence
  Peptide Derived from Human Papillomavirus
TVHVSSTH

SEQ ID NO: 39579 - protein, 8 aa, Artificial Sequence
  Peptide Derived from Human Papillomavirus
VAHRATRR

SEQ ID NO: 39580 - protein, 9 aa, Artificial Sequence
  Peptide Derived from Human Papillomavirus
VAHRATRRK

SEQ ID NO: 39581 - protein, 10 aa, Artificial Sequence
  Peptide Derived from Human Papillomavirus
VAHRATRRKR

SEQ ID NO: 39582 - protein, 11 aa, Artificial Sequence
  Peptide Derived from Human Papillomavirus
VAHRATRRKRA

SEQ ID NO: 39583 - protein, 8 aa, Artificial Sequence
  Peptide Derived from Human Papillomavirus
VALHRPAF

SEQ ID NO: 39584 - protein, 11 aa, Artificial Sequence
  Peptide Derived from Human Papillomavirus
VALHRPAFTTR

SEQ ID NO: 39585 - protein, 11 aa, Artificial Sequence
  Peptide Derived from Human Papillomavirus
VATPSAHLPIK

SEQ ID NO: 39586 - protein, 11 aa, Artificial Sequence
  Peptide Derived from Human Papillomavirus
VIESGAGIPNF

SEQ ID NO: 39587 - protein, 11 aa, Artificial Sequence
  Peptide Derived from Human Papillomavirus
VLPTGPSTWPF

SEQ ID NO: 39588 - protein, 8 aa, Artificial Sequence
  Peptide Derived from Human Papillomavirus
VSADNPLF

SEQ ID NO: 39589 - protein, 11 aa, Artificial Sequence
  Peptide Derived from Human Papillomavirus
VSSTHITNPLF

SEQ ID NO: 39590 - protein, 9 aa, Artificial Sequence
  Peptide Derived from Human Papillomavirus
VTDPAFLDR

SEQ ID NO: 39591 - protein, 11 aa, Artificial Sequence
  Peptide Derived from Human Papillomavirus
VTDPAFLDRPA

SEQ ID NO: 39592 - protein, 8 aa, Artificial Sequence
  Peptide Derived from Human Papillomavirus
VVNKIEQK

SEQ ID NO: 39593 - protein, 11 aa, Artificial Sequence
  Peptide Derived from Human Papillomavirus
VVNKIEQKTWA

SEQ ID NO: 39594 - protein, 8 aa, Artificial Sequence
  Peptide Derived from Human Papillomavirus
WGSLFTYF

SEQ ID NO: 39595 - protein, 8 aa, Artificial Sequence
  Peptide Derived from Human Papillomavirus
YANIDDEA

SEQ ID NO: 39596 - protein, 9 aa, Artificial Sequence
  Peptide Derived from Human Papillomavirus
YDISPIAQA

SEQ ID NO: 39597 - protein, 11 aa, Artificial Sequence
  Peptide Derived from Human Papillomavirus
YDIYANIDDEA

SEQ ID NO: 39598 - protein, 8 aa, Artificial Sequence
  Peptide Derived from Human Papillomavirus
YDVTHDVY

SEQ ID NO: 39599 - protein, 9 aa, Artificial Sequence
  Peptide Derived from Human Papillomavirus
YFFADGDVA

SEQ ID NO: 39600 - protein, 10 aa, Artificial Sequence
  Peptide Derived from Human Papillomavirus
YFFADGDVAA

SEQ ID NO: 39601 - protein, 8 aa, Artificial Sequence
  Peptide Derived from Human Papillomavirus
YFFRRRRR

SEQ ID NO: 39602 - protein, 9 aa, Artificial Sequence
  Peptide Derived from Human Papillomavirus
YFFRRRRRK

SEQ ID NO: 39603 - protein, 10 aa, Artificial Sequence
  Peptide Derived from Human Papillomavirus
YFFRRRRRKR

SEQ ID NO: 39604 - protein, 8 aa, Artificial Sequence
  Peptide Derived from Human Papillomavirus
YIQGSSFA

SEQ ID NO: 39605 - protein, 8 aa, Artificial Sequence
  Peptide Derived from Human Papillomavirus
AAALYWYK

SEQ ID NO: 39606 - protein, 8 aa, Artificial Sequence
  Peptide Derived from Human Papillomavirus
AAMLAKFK

SEQ ID NO: 39607 - protein, 11 aa, Artificial Sequence
  Peptide Derived from Human Papillomavirus
AAMLAKFKELY

SEQ ID NO: 39608 - protein, 11 aa, Artificial Sequence
  Peptide Derived from Human Papillomavirus
ADSIKTLLQQY

SEQ ID NO: 39609 - protein, 10 aa, Artificial Sequence
  Peptide Derived from Human Papillomavirus
AFLKSNSQAK

SEQ ID NO: 39610 - protein, 9 aa, Artificial Sequence
  Peptide Derived from Human Papillomavirus
AGTDSRWPY

SEQ ID NO: 39611 - protein, 11 aa, Artificial Sequence
  Peptide Derived from Human Papillomavirus
AGTDSRWPYLH

SEQ ID NO: 39612 - protein, 9 aa, Artificial Sequence
  Peptide Derived from Human Papillomavirus
AICIEKQSR

SEQ ID NO: 39613 - protein, 9 aa, Artificial Sequence
  Peptide Derived from Human Papillomavirus
ALFTAQEAK

SEQ ID NO: 39614 - protein, 11 aa, Artificial Sequence
  Peptide Derived from Human Papillomavirus
ALFTAQEAKQH

SEQ ID NO: 39615 - protein, 11 aa, Artificial Sequence
  Peptide Derived from Human Papillomavirus
ALKRFLQGIPK

SEQ ID NO: 39616 - protein, 10 aa, Artificial Sequence
  Peptide Derived from Human Papillomavirus
AMLAKFKELY

SEQ ID NO: 39617 - protein, 8 aa, Artificial Sequence
  Peptide Derived from Human Papillomavirus
ATMCRHYK

SEQ ID NO: 39618 - protein, 9 aa, Artificial Sequence
  Peptide Derived from Human Papillomavirus
ATMCRHYKR

SEQ ID NO: 39619 - protein, 8 aa, Artificial Sequence
  Peptide Derived from Human Papillomavirus
ATVPCWNY

SEQ ID NO: 39620 - protein, 8 aa, Artificial Sequence
  Peptide Derived from Human Papillomavirus
AVQVLKRK

SEQ ID NO: 39621 - protein, 9 aa, Artificial Sequence
  Peptide Derived from Human Papillomavirus
AVQVLKRKY

SEQ ID NO: 39622 - protein, 8 aa, Artificial Sequence
  Peptide Derived from Human Papillomavirus
CATMCRHY

SEQ ID NO: 39623 - protein, 9 aa, Artificial Sequence
  Peptide Derived from Human Papillomavirus
CATMCRHYK

SEQ ID NO: 39624 - protein, 10 aa, Artificial Sequence
  Peptide Derived from Human Papillomavirus
CATMCRHYKR

SEQ ID NO: 39625 - protein, 11 aa, Artificial Sequence
  Peptide Derived from Human Papillomavirus
CDRVDDGGDWK

SEQ ID NO: 39626 - protein, 8 aa, Artificial Sequence
  Peptide Derived from Human Papillomavirus
CFVNSKSH

SEQ ID NO: 39627 - protein, 10 aa, Artificial Sequence
  Peptide Derived from Human Papillomavirus
CGKNRETIEK

SEQ ID NO: 39628 - protein, 10 aa, Artificial Sequence
  Peptide Derived from Human Papillomavirus
CIEKQSRAAK

SEQ ID NO: 39629 - protein, 11 aa, Artificial Sequence
  Peptide Derived from Human Papillomavirus
CIEKQSRAAKR

SEQ ID NO: 39630 - protein, 8 aa, Artificial Sequence
  Peptide Derived from Human Papillomavirus
CMMIEPPK

SEQ ID NO: 39631 - protein, 10 aa, Artificial Sequence
  Peptide Derived from Human Papillomavirus
CMMIEPPKLR

SEQ ID NO: 39632 - protein, 9 aa, Artificial Sequence
  Peptide Derived from Human Papillomavirus
CVDNNISPR

SEQ ID NO: 39633 - protein, 11 aa, Artificial Sequence
  Peptide Derived from Human Papillomavirus
CVDNNISPRLK

SEQ ID NO: 39634 - protein, 9 aa, Artificial Sequence
  Peptide Derived from Human Papillomavirus
DATVPCWNY

SEQ ID NO: 39635 - protein, 8 aa, Artificial Sequence
  Peptide Derived from Human Papillomavirus
DAVQVLKR

SEQ ID NO: 39636 - protein, 9 aa, Artificial Sequence
  Peptide Derived from Human Papillomavirus
DAVQVLKRK

SEQ ID NO: 39637 - protein, 10 aa, Artificial Sequence
  Peptide Derived from Human Papillomavirus
DAVQVLKRKY

SEQ ID NO: 39638 - protein, 8 aa, Artificial Sequence
  Peptide Derived from Human Papillomavirus
DCATMCRH

SEQ ID NO: 39639 - protein, 9 aa, Artificial Sequence
  Peptide Derived from Human Papillomavirus
DCATMCRHY

SEQ ID NO: 39640 - protein, 10 aa, Artificial Sequence
  Peptide Derived from Human Papillomavirus
DCATMCRHYK

SEQ ID NO: 39641 - protein, 11 aa, Artificial Sequence
  Peptide Derived from Human Papillomavirus
DCATMCRHYKR

SEQ ID NO: 39642 - protein, 10 aa, Artificial Sequence
  Peptide Derived from Human Papillomavirus
DDATVPCWNY

SEQ ID NO: 39643 - protein, 8 aa, Artificial Sequence
  Peptide Derived from Human Papillomavirus
DDSEIAYK

SEQ ID NO: 39644 - protein, 9 aa, Artificial Sequence
  Peptide Derived from Human Papillomavirus
DDSEIAYKY

SEQ ID NO: 39645 - protein, 9 aa, Artificial Sequence
  Peptide Derived from Human Papillomavirus
DFIVNDNDY

SEQ ID NO: 39646 - protein, 9 aa, Artificial Sequence
  Peptide Derived from Human Papillomavirus
DGDSLPTFK

SEQ ID NO: 39647 - protein, 10 aa, Artificial Sequence
  Peptide Derived from Human Papillomavirus
DGNLVSMDVK

SEQ ID NO: 39648 - protein, 11 aa, Artificial Sequence
  Peptide Derived from Human Papillomavirus
DGNLVSMDVKH

SEQ ID NO: 39649 - protein, 10 aa, Artificial Sequence
  Peptide Derived from Human Papillomavirus
DIVDDSEIAY

SEQ ID NO: 39650 - protein, 11 aa, Artificial Sequence
  Peptide Derived from Human Papillomavirus
DIVDDSEIAYK

SEQ ID NO: 39651 - protein, 9 aa, Artificial Sequence
  Peptide Derived from Human Papillomavirus
DNNISPRLK

SEQ ID NO: 39652 - protein, 8 aa, Artificial Sequence
  Peptide Derived from Human Papillomavirus
DSEIAYKY

SEQ ID NO: 39653 - protein, 10 aa, Artificial Sequence
  Peptide Derived from Human Papillomavirus
DSIKTLLQQY

SEQ ID NO: 39654 - protein, 8 aa, Artificial Sequence
  Peptide Derived from Human Papillomavirus
DSRWPYLH

SEQ ID NO: 39655 - protein, 10 aa, Artificial Sequence
  Peptide Derived from Human Papillomavirus
DSRWPYLHNR

SEQ ID NO: 39656 - protein, 11 aa, Artificial Sequence
  Peptide Derived from Human Papillomavirus
DTNSNASAFLK

SEQ ID NO: 39657 - protein, 8 aa, Artificial Sequence
  Peptide Derived from Human Papillomavirus
DTPEWIQR

SEQ ID NO: 39658 - protein, 11 aa, Artificial Sequence
  Peptide Derived from Human Papillomavirus
DVKHRPLVQLK

SEQ ID NO: 39659 - protein, 10 aa, Artificial Sequence
  Peptide Derived from Human Papillomavirus
EFMSFLTALK

SEQ ID NO: 39660 - protein, 11 aa, Artificial Sequence
  Peptide Derived from Human Papillomavirus
EFMSFLTALKR

SEQ ID NO: 39661 - protein, 10 aa, Artificial Sequence
  Peptide Derived from Human Papillomavirus
EGTGCNGWFY

SEQ ID NO: 39662 - protein, 8 aa, Artificial Sequence
  Peptide Derived from Human Papillomavirus
ELNDKNWK

SEQ ID NO: 39663 - protein, 10 aa, Artificial Sequence
  Peptide Derived from Human Papillomavirus
ELSQMVQWAY

SEQ ID NO: 39664 - protein, 10 aa, Artificial Sequence
  Peptide Derived from Human Papillomavirus
ELVRPFKSNK

SEQ ID NO: 39665 - protein, 11 aa, Artificial Sequence
  Peptide Derived from Human Papillomavirus
ENDGDSLPTFK

SEQ ID NO: 39666 - protein, 9 aa, Artificial Sequence
  Peptide Derived from Human Papillomavirus
ETETPCSQY

SEQ ID NO: 39667 - protein, 9 aa, Artificial Sequence
  Peptide Derived from Human Papillomavirus
ETIEKLLSK

SEQ ID NO: 39668 - protein, 11 aa, Artificial Sequence
  Peptide Derived from Human Papillomavirus
ETQQMLQVEGR

SEQ ID NO: 39669 - protein, 9 aa, Artificial Sequence
  Peptide Derived from Human Papillomavirus
FDENGNPVY

SEQ ID NO: 39670 - protein, 8 aa, Artificial Sequence
  Peptide Derived from Human Papillomavirus
FFSRTWSR

SEQ ID NO: 39671 - protein, 8 aa, Artificial Sequence
  Peptide Derived from Human Papillomavirus
FIVNDNDY

SEQ ID NO: 39672 - protein, 9 aa, Artificial Sequence
  Peptide Derived from Human Papillomavirus
FLKSNSQAK

SEQ ID NO: 39673 - protein, 8 aa, Artificial Sequence
  Peptide Derived from Human Papillomavirus
FLQGIPKK

SEQ ID NO: 39674 - protein, 9 aa, Artificial Sequence
  Peptide Derived from Human Papillomavirus
FMSFLTALK

SEQ ID NO: 39675 - protein, 10 aa, Artificial Sequence
  Peptide Derived from Human Papillomavirus
FMSFLTALKR

SEQ ID NO: 39676 - protein, 9 aa, Artificial Sequence
  Peptide Derived from Human Papillomavirus
FSELVRPFK

SEQ ID NO: 39677 - protein, 11 aa, Artificial Sequence
  Peptide Derived from Human Papillomavirus
FSRTWSRLSLH

SEQ ID NO: 39678 - protein, 9 aa, Artificial Sequence
  Peptide Derived from Human Papillomavirus
FTAQEAKQH

SEQ ID NO: 39679 - protein, 10 aa, Artificial Sequence
  Peptide Derived from Human Papillomavirus
FTAQEAKQHR

SEQ ID NO: 39680 - protein, 10 aa, Artificial Sequence
  Peptide Derived from Human Papillomavirus
GCVDNNISPR

SEQ ID NO: 39681 - protein, 8 aa, Artificial Sequence
  Peptide Derived from Human Papillomavirus
GDSLPTFK

SEQ ID NO: 39682 - protein, 9 aa, Artificial Sequence
  Peptide Derived from Human Papillomavirus
GDTPEWIQR

SEQ ID NO: 39683 - protein, 11 aa, Artificial Sequence
  Peptide Derived from Human Papillomavirus
GDWKQIVMFLR

SEQ ID NO: 39684 - protein, 8 aa, Artificial Sequence
  Peptide Derived from Human Papillomavirus
GGEGVSER

SEQ ID NO: 39685 - protein, 9 aa, Artificial Sequence
  Peptide Derived from Human Papillomavirus
GGEGVSERH

SEQ ID NO: 39686 - protein, 10 aa, Artificial Sequence
  Peptide Derived from Human Papillomavirus
GGSGGGCSQY

SEQ ID NO: 39687 - protein, 11 aa, Artificial Sequence
  Peptide Derived from Human Papillomavirus
GIPKKNCILLY

SEQ ID NO: 39688 - protein, 9 aa, Artificial Sequence
  Peptide Derived from Human Papillomavirus
GISNISEVY

SEQ ID NO: 39689 - protein, 11 aa, Artificial Sequence
  Peptide Derived from Human Papillomavirus
GLTPSIADSIK

SEQ ID NO: 39690 - protein, 9 aa, Artificial Sequence
  Peptide Derived from Human Papillomavirus
GMVVLLLVR

SEQ ID NO: 39691 - protein, 10 aa, Artificial Sequence
  Peptide Derived from Human Papillomavirus
GMVVLLLVRY

SEQ ID NO: 39692 - protein, 11 aa, Artificial Sequence
  Peptide Derived from Human Papillomavirus
GMVVLLLVRYK

SEQ ID NO: 39693 - protein, 9 aa, Artificial Sequence
  Peptide Derived from Human Papillomavirus
GNLVSMDVK

SEQ ID NO: 39694 - protein, 10 aa, Artificial Sequence
  Peptide Derived from Human Papillomavirus
GNLVSMDVKH

SEQ ID NO: 39695 - protein, 11 aa, Artificial Sequence
  Peptide Derived from Human Papillomavirus
GNLVSMDVKHR

SEQ ID NO: 39696 - protein, 10 aa, Artificial Sequence
  Peptide Derived from Human Papillomavirus
GNPVYELNDK

SEQ ID NO: 39697 - protein, 10 aa, Artificial Sequence
  Peptide Derived from Human Papillomavirus
GSGGEGVSER

SEQ ID NO: 39698 - protein, 11 aa, Artificial Sequence
  Peptide Derived from Human Papillomavirus
GSGGEGVSERH

SEQ ID NO: 39699 - protein, 9 aa, Artificial Sequence
  Peptide Derived from Human Papillomavirus
GSGGGCSQY

SEQ ID NO: 39700 - protein, 10 aa, Artificial Sequence
  Peptide Derived from Human Papillomavirus
GSVICFVNSK

SEQ ID NO: 39701 - protein, 8 aa, Artificial Sequence
  Peptide Derived from Human Papillomavirus
GTDSRWPY

SEQ ID NO: 39702 - protein, 10 aa, Artificial Sequence
  Peptide Derived from Human Papillomavirus
GTDSRWPYLH

SEQ ID NO: 39703 - protein, 9 aa, Artificial Sequence
  Peptide Derived from Human Papillomavirus
GTGCNGWFY

SEQ ID NO: 39704 - protein, 9 aa, Artificial Sequence
  Peptide Derived from Human Papillomavirus
GVSFSELVR

SEQ ID NO: 39705 - protein, 10 aa, Artificial Sequence
  Peptide Derived from Human Papillomavirus
HALFTAQEAK

SEQ ID NO: 39706 - protein, 11 aa, Artificial Sequence
  Peptide Derived from Human Papillomavirus
HFWLQPLADAK

SEQ ID NO: 39707 - protein, 9 aa, Artificial Sequence
  Peptide Derived from Human Papillomavirus
ICFVNSKSH

SEQ ID NO: 39708 - protein, 8 aa, Artificial Sequence
  Peptide Derived from Human Papillomavirus
ICIEKQSR

SEQ ID NO: 39709 - protein, 11 aa, Artificial Sequence
  Peptide Derived from Human Papillomavirus
ICIEKQSRAAK

SEQ ID NO: 39710 - protein, 11 aa, Artificial Sequence
  Peptide Derived from Human Papillomavirus
ILLYGAANTGK

SEQ ID NO: 39711 - protein, 11 aa, Artificial Sequence
  Peptide Derived from Human Papillomavirus
ILNVLKTSNAK

SEQ ID NO: 39712 - protein, 8 aa, Artificial Sequence
  Peptide Derived from Human Papillomavirus
INAGTDSR

SEQ ID NO: 39713 - protein, 11 aa, Artificial Sequence
  Peptide Derived from Human Papillomavirus
INAGTDSRWPY

SEQ ID NO: 39714 - protein, 8 aa, Artificial Sequence
  Peptide Derived from Human Papillomavirus
ISNISEVY

SEQ ID NO: 39715 - protein, 9 aa, Artificial Sequence
  Peptide Derived from Human Papillomavirus
IVDDSEIAY

SEQ ID NO: 39716 - protein, 10 aa, Artificial Sequence
  Peptide Derived from Human Papillomavirus
IVDDSEIAYK

SEQ ID NO: 39717 - protein, 11 aa, Artificial Sequence
  Peptide Derived from Human Papillomavirus
IVDDSEIAYKY

SEQ ID NO: 39718 - protein, 10 aa, Artificial Sequence
  Peptide Derived from Human Papillomavirus
IVKDCATMCR

SEQ ID NO: 39719 - protein, 11 aa, Artificial Sequence
  Peptide Derived from Human Papillomavirus
IVKDCATMCRH

SEQ ID NO: 39720 - protein, 9 aa, Artificial Sequence
  Peptide Derived from Human Papillomavirus
KAAMLAKFK

SEQ ID NO: 39721 - protein, 10 aa, Artificial Sequence
  Peptide Derived from Human Papillomavirus
KAICIEKQSR

SEQ ID NO: 39722 - protein, 11 aa, Artificial Sequence
  Peptide Derived from Human Papillomavirus
KCGKNRETIEK

SEQ ID NO: 39723 - protein, 8 aa, Artificial Sequence
  Peptide Derived from Human Papillomavirus
KDCATMCR

SEQ ID NO: 39724 - protein, 9 aa, Artificial Sequence
  Peptide Derived from Human Papillomavirus
KDCATMCRH

SEQ ID NO: 39725 - protein, 10 aa, Artificial Sequence
  Peptide Derived from Human Papillomavirus
KDCATMCRHY

SEQ ID NO: 39726 - protein, 11 aa, Artificial Sequence
  Peptide Derived from Human Papillomavirus
KDCATMCRHYK

SEQ ID NO: 39727 - protein, 11 aa, Artificial Sequence
  Peptide Derived from Human Papillomavirus
KIVKDCATMCR

SEQ ID NO: 39728 - protein, 10 aa, Artificial Sequence
  Peptide Derived from Human Papillomavirus
KLRSTAAALY

SEQ ID NO: 39729 - protein, 8 aa, Artificial Sequence
  Peptide Derived from Human Papillomavirus
KNRETIEK

SEQ ID NO: 39730 - protein, 9 aa, Artificial Sequence
  Peptide Derived from Human Papillomavirus
KNWKSFFSR

SEQ ID NO: 39731 - protein, 10 aa, Artificial Sequence
  Peptide Derived from Human Papillomavirus
KSFFSRTWSR

SEQ ID NO: 39732 - protein, 10 aa, Artificial Sequence
  Peptide Derived from Human Papillomavirus
KSLFGMSLMK

SEQ ID NO: 39733 - protein, 10 aa, Artificial Sequence
  Peptide Derived from Human Papillomavirus
KSNSQAKIVK

SEQ ID NO: 39734 - protein, 11 aa, Artificial Sequence
  Peptide Derived from Human Papillomavirus
KTGISNISEVY

SEQ ID NO: 39735 - protein, 10 aa, Artificial Sequence
  Peptide Derived from Human Papillomavirus
KTLLQQYCLY

SEQ ID NO: 39736 - protein, 8 aa, Artificial Sequence
  Peptide Derived from Human Papillomavirus
LAKFKELY

SEQ ID NO: 39737 - protein, 11 aa, Artificial Sequence
  Peptide Derived from Human Papillomavirus
LDDATVPCWNY

SEQ ID NO: 39738 - protein, 11 aa, Artificial Sequence
  Peptide Derived from Human Papillomavirus
LDGNLVSMDVK

SEQ ID NO: 39739 - protein, 9 aa, Artificial Sequence
  Peptide Derived from Human Papillomavirus
LFESEDSGY

SEQ ID NO: 39740 - protein, 8 aa, Artificial Sequence
  Peptide Derived from Human Papillomavirus
LFGMSLMK

SEQ ID NO: 39741 - protein, 8 aa, Artificial Sequence
  Peptide Derived from Human Papillomavirus
LFTAQEAK

SEQ ID NO: 39742 - protein, 10 aa, Artificial Sequence
  Peptide Derived from Human Papillomavirus
LFTAQEAKQH

SEQ ID NO: 39743 - protein, 11 aa, Artificial Sequence
  Peptide Derived from Human Papillomavirus
LFTAQEAKQHR

SEQ ID NO: 39744 - protein, 10 aa, Artificial Sequence
  Peptide Derived from Human Papillomavirus
LLLVRYKCGK

SEQ ID NO: 39745 - protein, 8 aa, Artificial Sequence
  Peptide Derived from Human Papillomavirus
LLQQYCLY

SEQ ID NO: 39746 - protein, 10 aa, Artificial Sequence
  Peptide Derived from Human Papillomavirus
LLQQYCLYLH

SEQ ID NO: 39747 - protein, 9 aa, Artificial Sequence
  Peptide Derived from Human Papillomavirus
LLVRYKCGK

SEQ ID NO: 39748 - protein, 11 aa, Artificial Sequence
  Peptide Derived from Human Papillomavirus
LLVRYKCGKNR

SEQ ID NO: 39749 - protein, 10 aa, Artificial Sequence
  Peptide Derived from Human Papillomavirus
LLYGAANTGK

SEQ ID NO: 39750 - protein, 10 aa, Artificial Sequence
  Peptide Derived from Human Papillomavirus
LNVLKTSNAK

SEQ ID NO: 39751 - protein, 9 aa, Artificial Sequence
  Peptide Derived from Human Papillomavirus
LSLHEDEDK

SEQ ID NO: 39752 - protein, 9 aa, Artificial Sequence
  Peptide Derived from Human Papillomavirus
LSQMVQWAY

SEQ ID NO: 39753 - protein, 9 aa, Artificial Sequence
  Peptide Derived from Human Papillomavirus
LTNILNVLK

SEQ ID NO: 39754 - protein, 10 aa, Artificial Sequence
  Peptide Derived from Human Papillomavirus
LTPSIADSIK

SEQ ID NO: 39755 - protein, 10 aa, Artificial Sequence
  Peptide Derived from Human Papillomavirus
LTQAETETAH

SEQ ID NO: 39756 - protein, 11 aa, Artificial Sequence
  Peptide Derived from Human Papillomavirus
LVDFIVNDNDY

SEQ ID NO: 39757 - protein, 9 aa, Artificial Sequence
  Peptide Derived from Human Papillomavirus
LVRPFKSNK

SEQ ID NO: 39758 - protein, 8 aa, Artificial Sequence
  Peptide Derived from Human Papillomavirus
LVRYKCGK

SEQ ID NO: 39759 - protein, 10 aa, Artificial Sequence
  Peptide Derived from Human Papillomavirus
LVRYKCGKNR

SEQ ID NO: 39760 - protein, 8 aa, Artificial Sequence
  Peptide Derived from Human Papillomavirus
LVSMDVKH

SEQ ID NO: 39761 - protein, 9 aa, Artificial Sequence
  Peptide Derived from Human Papillomavirus
LVSMDVKHR

SEQ ID NO: 39762 - protein, 9 aa, Artificial Sequence
  Peptide Derived from Human Papillomavirus
MCMMIEPPK

SEQ ID NO: 39763 - protein, 11 aa, Artificial Sequence
  Peptide Derived from Human Papillomavirus
MCMMIEPPKLR

SEQ ID NO: 39764 - protein, 10 aa, Artificial Sequence
  Peptide Derived from Human Papillomavirus
MCRHYKRAEK

SEQ ID NO: 39765 - protein, 11 aa, Artificial Sequence
  Peptide Derived from Human Papillomavirus
MCRHYKRAEKK

SEQ ID NO: 39766 - protein, 8 aa, Artificial Sequence
  Peptide Derived from Human Papillomavirus
MIEPPKLR

SEQ ID NO: 39767 - protein, 9 aa, Artificial Sequence
  Peptide Derived from Human Papillomavirus
MLAKFKELY

SEQ ID NO: 39768 - protein, 8 aa, Artificial Sequence
  Peptide Derived from Human Papillomavirus
MLQVEGRH

SEQ ID NO: 39769 - protein, 9 aa, Artificial Sequence
  Peptide Derived from Human Papillomavirus
MMIEPPKLR

SEQ ID NO: 39770 - protein, 8 aa, Artificial Sequence
  Peptide Derived from Human Papillomavirus
MSFLTALK

SEQ ID NO: 39771 - protein, 9 aa, Artificial Sequence
  Peptide Derived from Human Papillomavirus
MSFLTALKR

SEQ ID NO: 39772 - protein, 8 aa, Artificial Sequence
  Peptide Derived from Human Papillomavirus
MSMSQWIK

SEQ ID NO: 39773 - protein, 9 aa, Artificial Sequence
  Peptide Derived from Human Papillomavirus
MSMSQWIKY

SEQ ID NO: 39774 - protein, 10 aa, Artificial Sequence
  Peptide Derived from Human Papillomavirus
MSMSQWIKYR

SEQ ID NO: 39775 - protein, 8 aa, Artificial Sequence
  Peptide Derived from Human Papillomavirus
MSQWIKYR

SEQ ID NO: 39776 - protein, 11 aa, Artificial Sequence
  Peptide Derived from Human Papillomavirus
MSQWIKYRCDR

SEQ ID NO: 39777 - protein, 8 aa, Artificial Sequence
  Peptide Derived from Human Papillomavirus
MVVLLLVR

SEQ ID NO: 39778 - protein, 9 aa, Artificial Sequence
  Peptide Derived from Human Papillomavirus
MVVLLLVRY

SEQ ID NO: 39779 - protein, 10 aa, Artificial Sequence
  Peptide Derived from Human Papillomavirus
MVVLLLVRYK

SEQ ID NO: 39780 - protein, 10 aa, Artificial Sequence
  Peptide Derived from Human Papillomavirus
NAGTDSRWPY

SEQ ID NO: 39781 - protein, 9 aa, Artificial Sequence
  Peptide Derived from Human Papillomavirus
NAKAAMLAK

SEQ ID NO: 39782 - protein, 11 aa, Artificial Sequence
  Peptide Derived from Human Papillomavirus
NAKAAMLAKFK

SEQ ID NO: 39783 - protein, 10 aa, Artificial Sequence
  Peptide Derived from Human Papillomavirus
NDGDSLPTFK

SEQ ID NO: 39784 - protein, 11 aa, Artificial Sequence
  Peptide Derived from Human Papillomavirus
NDIVDDSEIAY

SEQ ID NO: 39785 - protein, 11 aa, Artificial Sequence
  Peptide Derived from Human Papillomavirus
NDKNWKSFFSR

SEQ ID NO: 39786 - protein, 11 aa, Artificial Sequence
  Peptide Derived from Human Papillomavirus
NGNPVYELNDK

SEQ ID NO: 39787 - protein, 9 aa, Artificial Sequence
  Peptide Derived from Human Papillomavirus
NINAGTDSR

SEQ ID NO: 39788 - protein, 8 aa, Artificial Sequence
  Peptide Derived from Human Papillomavirus
NLVSMDVK

SEQ ID NO: 39789 - protein, 9 aa, Artificial Sequence
  Peptide Derived from Human Papillomavirus
NLVSMDVKH

SEQ ID NO: 39790 - protein, 10 aa, Artificial Sequence
  Peptide Derived from Human Papillomavirus
NLVSMDVKHR

SEQ ID NO: 39791 - protein, 8 aa, Artificial Sequence
  Peptide Derived from Human Papillomavirus
NNISPRLK

SEQ ID NO: 39792 - protein, 9 aa, Artificial Sequence
  Peptide Derived from Human Papillomavirus
NSNASAFLK

SEQ ID NO: 39793 - protein, 8 aa, Artificial Sequence
  Peptide Derived from Human Papillomavirus
NSQAKIVK

SEQ ID NO: 39794 - protein, 9 aa, Artificial Sequence
  Peptide Derived from Human Papillomavirus
NVLKTSNAK

SEQ ID NO: 39795 - protein, 11 aa, Artificial Sequence
  Peptide Derived from Human Papillomavirus
PCWNYIDDNLR

SEQ ID NO: 39796 - protein, 10 aa, Artificial Sequence
  Peptide Derived from Human Papillomavirus
PFDENGNPVY

SEQ ID NO: 39797 - protein, 10 aa, Artificial Sequence
  Peptide Derived from Human Papillomavirus
PLTNILNVLK

SEQ ID NO: 39798 - protein, 10 aa, Artificial Sequence
  Peptide Derived from Human Papillomavirus
PMCMMIEPPK

SEQ ID NO: 39799 - protein, 8 aa, Artificial Sequence
  Peptide Derived from Human Papillomavirus
PSIADSIK

SEQ ID NO: 39800 - protein, 8 aa, Artificial Sequence
  Peptide Derived from Human Papillomavirus
PVYELNDK

SEQ ID NO: 39801 - protein, 11 aa, Artificial Sequence
  Peptide Derived from Human Papillomavirus
PVYELNDKNWK

SEQ ID NO: 39802 - protein, 8 aa, Artificial Sequence
  Peptide Derived from Human Papillomavirus
QAETETAH

SEQ ID NO: 39803 - protein, 11 aa, Artificial Sequence
  Peptide Derived from Human Papillomavirus
QGSVICFVNSK

SEQ ID NO: 39804 - protein, 8 aa, Artificial Sequence
  Peptide Derived from Human Papillomavirus
QIVMFLRY

SEQ ID NO: 39805 - protein, 8 aa, Artificial Sequence
  Peptide Derived from Human Papillomavirus
QMLQVEGR

SEQ ID NO: 39806 - protein, 9 aa, Artificial Sequence
  Peptide Derived from Human Papillomavirus
QMLQVEGRH

SEQ ID NO: 39807 - protein, 9 aa, Artificial Sequence
  Peptide Derived from Human Papillomavirus
QMSMSQWIK

SEQ ID NO: 39808 - protein, 10 aa, Artificial Sequence
  Peptide Derived from Human Papillomavirus
QMSMSQWIKY

SEQ ID NO: 39809 - protein, 11 aa, Artificial Sequence
  Peptide Derived from Human Papillomavirus
QMSMSQWIKYR

SEQ ID NO: 39810 - protein, 8 aa, Artificial Sequence
  Peptide Derived from Human Papillomavirus
QSRAAKRR

SEQ ID NO: 39811 - protein, 8 aa, Artificial Sequence
  Peptide Derived from Human Papillomavirus
RDAVQVLK

SEQ ID NO: 39812 - protein, 9 aa, Artificial Sequence
  Peptide Derived from Human Papillomavirus
RDAVQVLKR

SEQ ID NO: 39813 - protein, 10 aa, Artificial Sequence
  Peptide Derived from Human Papillomavirus
RDAVQVLKRK

SEQ ID NO: 39814 - protein, 11 aa, Artificial Sequence
  Peptide Derived from Human Papillomavirus
RDAVQVLKRKY

SEQ ID NO: 39815 - protein, 8 aa, Artificial Sequence
  Peptide Derived from Human Papillomavirus
RFLQGIPK

SEQ ID NO: 39816 - protein, 9 aa, Artificial Sequence
  Peptide Derived from Human Papillomavirus
RFLQGIPKK

SEQ ID NO: 39817 - protein, 10 aa, Artificial Sequence
  Peptide Derived from Human Papillomavirus
RLFESEDSGY

SEQ ID NO: 39818 - protein, 9 aa, Artificial Sequence
  Peptide Derived from Human Papillomavirus
RLKAICIEK

SEQ ID NO: 39819 - protein, 10 aa, Artificial Sequence
  Peptide Derived from Human Papillomavirus
RLSLHEDEDK

SEQ ID NO: 39820 - protein, 8 aa, Artificial Sequence
  Peptide Derived from Human Papillomavirus
RSTAAALY

SEQ ID NO: 39821 - protein, 10 aa, Artificial Sequence
  Peptide Derived from Human Papillomavirus
RSTAAALYWY

SEQ ID NO: 39822 - protein, 11 aa, Artificial Sequence
  Peptide Derived from Human Papillomavirus
RSTAAALYWYK

SEQ ID NO: 39823 - protein, 9 aa, Artificial Sequence
  Peptide Derived from Human Papillomavirus
RTWSRLSLH

SEQ ID NO: 39824 - protein, 9 aa, Artificial Sequence
  Peptide Derived from Human Papillomavirus
RVDDGGDWK

SEQ ID NO: 39825 - protein, 11 aa, Artificial Sequence
  Peptide Derived from Human Papillomavirus
SAFLKSNSQAK

SEQ ID NO: 39826 - protein, 9 aa, Artificial Sequence
  Peptide Derived from Human Papillomavirus
SFFSRTWSR

SEQ ID NO: 39827 - protein, 8 aa, Artificial Sequence
  Peptide Derived from Human Papillomavirus
SFLTALKR

SEQ ID NO: 39828 - protein, 10 aa, Artificial Sequence
  Peptide Derived from Human Papillomavirus
SFSELVRPFK

SEQ ID NO: 39829 - protein, 11 aa, Artificial Sequence
  Peptide Derived from Human Papillomavirus
SGCVDNNISPR

SEQ ID NO: 39830 - protein, 9 aa, Artificial Sequence
  Peptide Derived from Human Papillomavirus
SGGEGVSER

SEQ ID NO: 39831 - protein, 10 aa, Artificial Sequence
  Peptide Derived from Human Papillomavirus
SGGEGVSERH

SEQ ID NO: 39832 - protein, 8 aa, Artificial Sequence
  Peptide Derived from Human Papillomavirus
SGGGCSQY

SEQ ID NO: 39833 - protein, 11 aa, Artificial Sequence
  Peptide Derived from Human Papillomavirus
SGGSGGGCSQY

SEQ ID NO: 39834 - protein, 11 aa, Artificial Sequence
  Peptide Derived from Human Papillomavirus
SGSGGEGVSER

SEQ ID NO: 39835 - protein, 9 aa, Artificial Sequence
  Peptide Derived from Human Papillomavirus
SIKTLLQQY

SEQ ID NO: 39836 - protein, 9 aa, Artificial Sequence
  Peptide Derived from Human Papillomavirus
SLFGMSLMK

SEQ ID NO: 39837 - protein, 8 aa, Artificial Sequence
  Peptide Derived from Human Papillomavirus
SLHEDEDK

SEQ ID NO: 39838 - protein, 8 aa, Artificial Sequence
  Peptide Derived from Human Papillomavirus
SMSQWIKY

SEQ ID NO: 39839 - protein, 9 aa, Artificial Sequence
  Peptide Derived from Human Papillomavirus
SMSQWIKYR

SEQ ID NO: 39840 - protein, 10 aa, Artificial Sequence
  Peptide Derived from Human Papillomavirus
SNAKAAMLAK

SEQ ID NO: 39841 - protein, 8 aa, Artificial Sequence
  Peptide Derived from Human Papillomavirus
SNASAFLK

SEQ ID NO: 39842 - protein, 10 aa, Artificial Sequence
  Peptide Derived from Human Papillomavirus
SNINAGTDSR

SEQ ID NO: 39843 - protein, 9 aa, Artificial Sequence
  Peptide Derived from Human Papillomavirus
SNSQAKIVK

SEQ ID NO: 39844 - protein, 9 aa, Artificial Sequence
  Peptide Derived from Human Papillomavirus
STAAALYWY

SEQ ID NO: 39845 - protein, 10 aa, Artificial Sequence
  Peptide Derived from Human Papillomavirus
STAAALYWYK

SEQ ID NO: 39846 - protein, 9 aa, Artificial Sequence
  Peptide Derived from Human Papillomavirus
SVICFVNSK

SEQ ID NO: 39847 - protein, 11 aa, Artificial Sequence
  Peptide Derived from Human Papillomavirus
SVICFVNSKSH

SEQ ID NO: 39848 - protein, 8 aa, Artificial Sequence
  Peptide Derived from Human Papillomavirus
TAAALYWY

SEQ ID NO: 39849 - protein, 9 aa, Artificial Sequence
  Peptide Derived from Human Papillomavirus
TAAALYWYK

SEQ ID NO: 39850 - protein, 8 aa, Artificial Sequence
  Peptide Derived from Human Papillomavirus
TAQEAKQH

SEQ ID NO: 39851 - protein, 9 aa, Artificial Sequence
  Peptide Derived from Human Papillomavirus
TAQEAKQHR

SEQ ID NO: 39852 - protein, 9 aa, Artificial Sequence
  Peptide Derived from Human Papillomavirus
TDSRWPYLH

SEQ ID NO: 39853 - protein, 11 aa, Artificial Sequence
  Peptide Derived from Human Papillomavirus
TDSRWPYLHNR

SEQ ID NO: 39854 - protein, 8 aa, Artificial Sequence
  Peptide Derived from Human Papillomavirus
TGCNGWFY

SEQ ID NO: 39855 - protein, 10 aa, Artificial Sequence
  Peptide Derived from Human Papillomavirus
TGISNISEVY

SEQ ID NO: 39856 - protein, 8 aa, Artificial Sequence
  Peptide Derived from Human Papillomavirus
TIEKLLSK

SEQ ID NO: 39857 - protein, 9 aa, Artificial Sequence
  Peptide Derived from Human Papillomavirus
TLLQQYCLY

SEQ ID NO: 39858 - protein, 11 aa, Artificial Sequence
  Peptide Derived from Human Papillomavirus
TLLQQYCLYLH

SEQ ID NO: 39859 - protein, 8 aa, Artificial Sequence
  Peptide Derived from Human Papillomavirus
TMCRHYKR

SEQ ID NO: 39860 - protein, 11 aa, Artificial Sequence
  Peptide Derived from Human Papillomavirus
TMCRHYKRAEK

SEQ ID NO: 39861 - protein, 8 aa, Artificial Sequence
  Peptide Derived from Human Papillomavirus
TNILNVLK

SEQ ID NO: 39862 - protein, 10 aa, Artificial Sequence
  Peptide Derived from Human Papillomavirus
TNSNASAFLK

SEQ ID NO: 39863 - protein, 11 aa, Artificial Sequence
  Peptide Derived from Human Papillomavirus
TSNAKAAMLAK

SEQ ID NO: 39864 - protein, 11 aa, Artificial Sequence
  Peptide Derived from Human Papillomavirus
TSNINAGTDSR

SEQ ID NO: 39865 - protein, 8 aa, Artificial Sequence
  Peptide Derived from Human Papillomavirus
VDDGGDWK

SEQ ID NO: 39866 - protein, 8 aa, Artificial Sequence
  Peptide Derived from Human Papillomavirus
VDDSEIAY

SEQ ID NO: 39867 - protein, 9 aa, Artificial Sequence
  Peptide Derived from Human Papillomavirus
VDDSEIAYK

SEQ ID NO: 39868 - protein, 10 aa, Artificial Sequence
  Peptide Derived from Human Papillomavirus
VDDSEIAYKY

SEQ ID NO: 39869 - protein, 10 aa, Artificial Sequence
  Peptide Derived from Human Papillomavirus
VDFIVNDNDY

SEQ ID NO: 39870 - protein, 8 aa, Artificial Sequence
  Peptide Derived from Human Papillomavirus
VDNNISPR

SEQ ID NO: 39871 - protein, 10 aa, Artificial Sequence
  Peptide Derived from Human Papillomavirus
VDNNISPRLK

SEQ ID NO: 39872 - protein, 8 aa, Artificial Sequence
  Peptide Derived from Human Papillomavirus
VICFVNSK

SEQ ID NO: 39873 - protein, 10 aa, Artificial Sequence
  Peptide Derived from Human Papillomavirus
VICFVNSKSH

SEQ ID NO: 39874 - protein, 8 aa, Artificial Sequence
  Peptide Derived from Human Papillomavirus
VLKTSNAK

SEQ ID NO: 39875 - protein, 8 aa, Artificial Sequence
  Peptide Derived from Human Papillomavirus
VLLLVRYK

SEQ ID NO: 39876 - protein, 11 aa, Artificial Sequence
  Peptide Derived from Human Papillomavirus
VLLLVRYKCGK

SEQ ID NO: 39877 - protein, 8 aa, Artificial Sequence
  Peptide Derived from Human Papillomavirus
VSFSELVR

SEQ ID NO: 39878 - protein, 11 aa, Artificial Sequence
  Peptide Derived from Human Papillomavirus
VSFSELVRPFK

SEQ ID NO: 39879 - protein, 8 aa, Artificial Sequence
  Peptide Derived from Human Papillomavirus
VSMDVKHR

SEQ ID NO: 39880 - protein, 8 aa, Artificial Sequence
  Peptide Derived from Human Papillomavirus
VVLLLVRY

SEQ ID NO: 39881 - protein, 9 aa, Artificial Sequence
  Peptide Derived from Human Papillomavirus
VVLLLVRYK

SEQ ID NO: 39882 - protein, 10 aa, Artificial Sequence
  Peptide Derived from Human Papillomavirus
WFYVEAVVEK

SEQ ID NO: 39883 - protein, 11 aa, Artificial Sequence
  Peptide Derived from Human Papillomavirus
WFYVEAVVEKK

SEQ ID NO: 39884 - protein, 10 aa, Artificial Sequence
  Peptide Derived from Human Papillomavirus
WGMVVLLLVR

SEQ ID NO: 39885 - protein, 11 aa, Artificial Sequence
  Peptide Derived from Human Papillomavirus
WGMVVLLLVRY

SEQ ID NO: 39886 - protein, 8 aa, Artificial Sequence
  Peptide Derived from Human Papillomavirus
WIKYRCDR

SEQ ID NO: 39887 - protein, 10 aa, Artificial Sequence
  Peptide Derived from Human Papillomavirus
WIQRQTVLQH

SEQ ID NO: 39888 - protein, 9 aa, Artificial Sequence
  Peptide Derived from Human Papillomavirus
WLQPLADAK

SEQ ID NO: 39889 - protein, 9 aa, Artificial Sequence
  Peptide Derived from Human Papillomavirus
WNYIDDNLR

SEQ ID NO: 39890 - protein, 8 aa, Artificial Sequence
  Peptide Derived from Human Papillomavirus
YGAANTGK

SEQ ID NO: 39891 - protein, 10 aa, Artificial Sequence
  Peptide Derived from Human Papillomavirus
YGDTPEWIQR

SEQ ID NO: 39892 - protein, 10 aa, Artificial Sequence
  Peptide Derived from Human Papillomavirus
YGVSFSELVR

SEQ ID NO: 39893 - protein, 11 aa, Artificial Sequence
  Peptide Derived from Human Papillomavirus
YLTQAETETAH

SEQ ID NO: 39894 - protein, 8 aa, Artificial Sequence
  Peptide Derived from Human Papillomavirus
YVEAVVEK

SEQ ID NO: 39895 - protein, 9 aa, Artificial Sequence
  Peptide Derived from Human Papillomavirus
YVEAVVEKK

SEQ ID NO: 39896 - protein, 9 aa, Artificial Sequence
  Peptide Derived from Human Papillomavirus
AFNSSHKGR

SEQ ID NO: 39897 - protein, 8 aa, Artificial Sequence
  Peptide Derived from Human Papillomavirus
ANHPAATH

SEQ ID NO: 39898 - protein, 10 aa, Artificial Sequence
  Peptide Derived from Human Papillomavirus
ANHPAATHTK

SEQ ID NO: 39899 - protein, 8 aa, Artificial Sequence
  Peptide Derived from Human Papillomavirus
ANTLKCLR

SEQ ID NO: 39900 - protein, 9 aa, Artificial Sequence
  Peptide Derived from Human Papillomavirus
ANTLKCLRY

SEQ ID NO: 39901 - protein, 10 aa, Artificial Sequence
  Peptide Derived from Human Papillomavirus
ANTLKCLRYR

SEQ ID NO: 39902 - protein, 11 aa, Artificial Sequence
  Peptide Derived from Human Papillomavirus
AVSSTWHWTGH

SEQ ID NO: 39903 - protein, 8 aa, Artificial Sequence
  Peptide Derived from Human Papillomavirus
CAIYYKAR

SEQ ID NO: 39904 - protein, 8 aa, Artificial Sequence
  Peptide Derived from Human Papillomavirus
CLRYRFKK

SEQ ID NO: 39905 - protein, 9 aa, Artificial Sequence
  Peptide Derived from Human Papillomavirus
CLRYRFKKH

SEQ ID NO: 39906 - protein, 10 aa, Artificial Sequence
  Peptide Derived from Human Papillomavirus
CNSNTTPIVH

SEQ ID NO: 39907 - protein, 11 aa, Artificial Sequence
  Peptide Derived from Human Papillomavirus
CNTMHYTNWTH

SEQ ID NO: 39908 - protein, 9 aa, Artificial Sequence
  Peptide Derived from Human Papillomavirus
DAEKYSKNK

SEQ ID NO: 39909 - protein, 9 aa, Artificial Sequence
  Peptide Derived from Human Papillomavirus
DANTLKCLR

SEQ ID NO: 39910 - protein, 10 aa, Artificial Sequence
  Peptide Derived from Human Papillomavirus
DANTLKCLRY

SEQ ID NO: 39911 - protein, 11 aa, Artificial Sequence
  Peptide Derived from Human Papillomavirus
DANTLKCLRYR

SEQ ID NO: 39912 - protein, 8 aa, Artificial Sequence
  Peptide Derived from Human Papillomavirus
DDAEKYSK

SEQ ID NO: 39913 - protein, 10 aa, Artificial Sequence
  Peptide Derived from Human Papillomavirus
DDAEKYSKNK

SEQ ID NO: 39914 - protein, 9 aa, Artificial Sequence
  Peptide Derived from Human Papillomavirus
DGDICNTMH

SEQ ID NO: 39915 - protein, 10 aa, Artificial Sequence
  Peptide Derived from Human Papillomavirus
DGDICNTMHY

SEQ ID NO: 39916 - protein, 8 aa, Artificial Sequence
  Peptide Derived from Human Papillomavirus
DICNTMHY

SEQ ID NO: 39917 - protein, 8 aa, Artificial Sequence
  Peptide Derived from Human Papillomavirus
DLRDHIDY

SEQ ID NO: 39918 - protein, 10 aa, Artificial Sequence
  Peptide Derived from Human Papillomavirus
DLRDHIDYWK

SEQ ID NO: 39919 - protein, 11 aa, Artificial Sequence
  Peptide Derived from Human Papillomavirus
DLRDHIDYWKH

SEQ ID NO: 39920 - protein, 8 aa, Artificial Sequence
  Peptide Derived from Human Papillomavirus
DSTDLRDH

SEQ ID NO: 39921 - protein, 11 aa, Artificial Sequence
  Peptide Derived from Human Papillomavirus
DSTDLRDHIDY

SEQ ID NO: 39922 - protein, 10 aa, Artificial Sequence
  Peptide Derived from Human Papillomavirus
DTGNPCHTTK

SEQ ID NO: 39923 - protein, 9 aa, Artificial Sequence
  Peptide Derived from Human Papillomavirus
ECAIYYKAR

SEQ ID NO: 39924 - protein, 11 aa, Artificial Sequence
  Peptide Derived from Human Papillomavirus
EGIRTYFVQFK

SEQ ID NO: 39925 - protein, 10 aa, Artificial Sequence
  Peptide Derived from Human Papillomavirus
EGQVDYYGLY

SEQ ID NO: 39926 - protein, 11 aa, Artificial Sequence
  Peptide Derived from Human Papillomavirus
EGQVDYYGLYY

SEQ ID NO: 39927 - protein, 10 aa, Artificial Sequence
  Peptide Derived from Human Papillomavirus
EIIRQHLANH

SEQ ID NO: 39928 - protein, 10 aa, Artificial Sequence
  Peptide Derived from Human Papillomavirus
ELQLTLETIY

SEQ ID NO: 39929 - protein, 9 aa, Artificial Sequence
  Peptide Derived from Human Papillomavirus
EMGFKHINH

SEQ ID NO: 39930 - protein, 8 aa, Artificial Sequence
  Peptide Derived from Human Papillomavirus
ENDSTDLR

SEQ ID NO: 39931 - protein, 10 aa, Artificial Sequence
  Peptide Derived from Human Papillomavirus
ENDSTDLRDH

SEQ ID NO: 39932 - protein, 8 aa, Artificial Sequence
  Peptide Derived from Human Papillomavirus
ETIYNSQY

SEQ ID NO: 39933 - protein, 8 aa, Artificial Sequence
  Peptide Derived from Human Papillomavirus
ETQTTIQR

SEQ ID NO: 39934 - protein, 10 aa, Artificial Sequence
  Peptide Derived from Human Papillomavirus
ETQTTIQRPR

SEQ ID NO: 39935 - protein, 9 aa, Artificial Sequence
  Peptide Derived from Human Papillomavirus
EVSSPEIIR

SEQ ID NO: 39936 - protein, 11 aa, Artificial Sequence
  Peptide Derived from Human Papillomavirus
EVSSPEIIRQH

SEQ ID NO: 39937 - protein, 10 aa, Artificial Sequence
  Peptide Derived from Human Papillomavirus
FDGDICNTMH

SEQ ID NO: 39938 - protein, 11 aa, Artificial Sequence
  Peptide Derived from Human Papillomavirus
FDGDICNTMHY

SEQ ID NO: 39939 - protein, 9 aa, Artificial Sequence
  Peptide Derived from Human Papillomavirus
FLSQVKIPK

SEQ ID NO: 39940 - protein, 8 aa, Artificial Sequence
  Peptide Derived from Human Papillomavirus
FNSSHKGR

SEQ ID NO: 39941 - protein, 10 aa, Artificial Sequence
  Peptide Derived from Human Papillomavirus
FVQFKDDAEK

SEQ ID NO: 39942 - protein, 11 aa, Artificial Sequence
  Peptide Derived from Human Papillomavirus
FVQFKDDAEKY

SEQ ID NO: 39943 - protein, 8 aa, Artificial Sequence
  Peptide Derived from Human Papillomavirus
GCIKKHGY

SEQ ID NO: 39944 - protein, 10 aa, Artificial Sequence
  Peptide Derived from Human Papillomavirus
GDANTLKCLR

SEQ ID NO: 39945 - protein, 11 aa, Artificial Sequence
  Peptide Derived from Human Papillomavirus
GDANTLKCLRY

SEQ ID NO: 39946 - protein, 8 aa, Artificial Sequence
  Peptide Derived from Human Papillomavirus
GDICNTMH

SEQ ID NO: 39947 - protein, 9 aa, Artificial Sequence
  Peptide Derived from Human Papillomavirus
GDICNTMHY

SEQ ID NO: 39948 - protein, 10 aa, Artificial Sequence
  Peptide Derived from Human Papillomavirus
GIRTYFVQFK

SEQ ID NO: 39949 - protein, 10 aa, Artificial Sequence
  Peptide Derived from Human Papillomavirus
GLYYVHEGIR

SEQ ID NO: 39950 - protein, 8 aa, Artificial Sequence
  Peptide Derived from Human Papillomavirus
GNPCHTTK

SEQ ID NO: 39951 - protein, 11 aa, Artificial Sequence
  Peptide Derived from Human Papillomavirus
GNPCHTTKLLH

SEQ ID NO: 39952 - protein, 11 aa, Artificial Sequence
  Peptide Derived from Human Papillomavirus
GTEETQTTIQR

SEQ ID NO: 39953 - protein, 9 aa, Artificial Sequence
  Peptide Derived from Human Papillomavirus
HIDYWKHMR

SEQ ID NO: 39954 - protein, 10 aa, Artificial Sequence
  Peptide Derived from Human Papillomavirus
HLANHPAATH

SEQ ID NO: 39955 - protein, 10 aa, Artificial Sequence
  Peptide Derived from Human Papillomavirus
HLKGDANTLK

SEQ ID NO: 39956 - protein, 9 aa, Artificial Sequence
  Peptide Derived from Human Papillomavirus
HMRLECAIY

SEQ ID NO: 39957 - protein, 10 aa, Artificial Sequence
  Peptide Derived from Human Papillomavirus
HMRLECAIYY

SEQ ID NO: 39958 - protein, 11 aa, Artificial Sequence
  Peptide Derived from Human Papillomavirus
HMRLECAIYYK

SEQ ID NO: 39959 - protein, 8 aa, Artificial Sequence
  Peptide Derived from Human Papillomavirus
HTTKLLHR

SEQ ID NO: 39960 - protein, 8 aa, Artificial Sequence
  Peptide Derived from Human Papillomavirus
IDYWKHMR

SEQ ID NO: 39961 - protein, 9 aa, Artificial Sequence
  Peptide Derived from Human Papillomavirus
IIRQHLANH

SEQ ID NO: 39962 - protein, 9 aa, Artificial Sequence
  Peptide Derived from Human Papillomavirus
ILTAFNSSH

SEQ ID NO: 39963 - protein, 10 aa, Artificial Sequence
  Peptide Derived from Human Papillomavirus
ILTAFNSSHK

SEQ ID NO: 39964 - protein, 8 aa, Artificial Sequence
  Peptide Derived from Human Papillomavirus
KAREMGFK

SEQ ID NO: 39965 - protein, 9 aa, Artificial Sequence
  Peptide Derived from Human Papillomavirus
KAREMGFKH

SEQ ID NO: 39966 - protein, 8 aa, Artificial Sequence
  Peptide Derived from Human Papillomavirus
KCLRYRFK

SEQ ID NO: 39967 - protein, 9 aa, Artificial Sequence
  Peptide Derived from Human Papillomavirus
KCLRYRFKK

SEQ ID NO: 39968 - protein, 10 aa, Artificial Sequence
  Peptide Derived from Human Papillomavirus
KCLRYRFKKH

SEQ ID NO: 39969 - protein, 9 aa, Artificial Sequence
  Peptide Derived from Human Papillomavirus
KDDAEKYSK

SEQ ID NO: 39970 - protein, 11 aa, Artificial Sequence
  Peptide Derived from Human Papillomavirus
KDDAEKYSKNK

SEQ ID NO: 39971 - protein, 8 aa, Artificial Sequence
  Peptide Derived from Human Papillomavirus
KGDANTLK

SEQ ID NO: 39972 - protein, 11 aa, Artificial Sequence
  Peptide Derived from Human Papillomavirus
KGDANTLKCLR

SEQ ID NO: 39973 - protein, 8 aa, Artificial Sequence
  Peptide Derived from Human Papillomavirus
KNKVWEVH

SEQ ID NO: 39974 - protein, 9 aa, Artificial Sequence
  Peptide Derived from Human Papillomavirus
KSAIVTLTY

SEQ ID NO: 39975 - protein, 9 aa, Artificial Sequence
  Peptide Derived from Human Papillomavirus
LANHPAATH

SEQ ID NO: 39976 - protein, 11 aa, Artificial Sequence
  Peptide Derived from Human Papillomavirus
LANHPAATHTK

SEQ ID NO: 39977 - protein, 11 aa, Artificial Sequence
  Peptide Derived from Human Papillomavirus
LCQRLNVCQDK

SEQ ID NO: 39978 - protein, 11 aa, Artificial Sequence
  Peptide Derived from Human Papillomavirus
LNVCQDKILTH

SEQ ID NO: 39979 - protein, 8 aa, Artificial Sequence
  Peptide Derived from Human Papillomavirus
LSQVKIPK

SEQ ID NO: 39980 - protein, 8 aa, Artificial Sequence
  Peptide Derived from Human Papillomavirus
LTAFNSSH

SEQ ID NO: 39981 - protein, 9 aa, Artificial Sequence
  Peptide Derived from Human Papillomavirus
LTAFNSSHK

SEQ ID NO: 39982 - protein, 11 aa, Artificial Sequence
  Peptide Derived from Human Papillomavirus
LTAFNSSHKGR

SEQ ID NO: 39983 - protein, 9 aa, Artificial Sequence
  Peptide Derived from Human Papillomavirus
LTAPTGCIK

SEQ ID NO: 39984 - protein, 10 aa, Artificial Sequence
  Peptide Derived from Human Papillomavirus
LTAPTGCIKK

SEQ ID NO: 39985 - protein, 11 aa, Artificial Sequence
  Peptide Derived from Human Papillomavirus
LTAPTGCIKKH

SEQ ID NO: 39986 - protein, 11 aa, Artificial Sequence
  Peptide Derived from Human Papillomavirus
LTLETIYNSQY

SEQ ID NO: 39987 - protein, 9 aa, Artificial Sequence
  Peptide Derived from Human Papillomavirus
LTYDSEWQR

SEQ ID NO: 39988 - protein, 8 aa, Artificial Sequence
  Peptide Derived from Human Papillomavirus
MGFKHINH

SEQ ID NO: 39989 - protein, 11 aa, Artificial Sequence
  Peptide Derived from Human Papillomavirus
NCNSNTTPIVH

SEQ ID NO: 39990 - protein, 9 aa, Artificial Sequence
  Peptide Derived from Human Papillomavirus
NDSTDLRDH

SEQ ID NO: 39991 - protein, 9 aa, Artificial Sequence
  Peptide Derived from Human Papillomavirus
NSNTTPIVH

SEQ ID NO: 39992 - protein, 11 aa, Artificial Sequence
  Peptide Derived from Human Papillomavirus
NSNTTPIVHLK

SEQ ID NO: 39993 - protein, 8 aa, Artificial Sequence
  Peptide Derived from Human Papillomavirus
NSQYSNEK

SEQ ID NO: 39994 - protein, 8 aa, Artificial Sequence
  Peptide Derived from Human Papillomavirus
NTLKCLRY

SEQ ID NO: 39995 - protein, 9 aa, Artificial Sequence
  Peptide Derived from Human Papillomavirus
NTLKCLRYR

SEQ ID NO: 39996 - protein, 11 aa, Artificial Sequence
  Peptide Derived from Human Papillomavirus
NTLKCLRYRFK

SEQ ID NO: 39997 - protein, 10 aa, Artificial Sequence
  Peptide Derived from Human Papillomavirus
NTMHYTNWTH

SEQ ID NO: 39998 - protein, 9 aa, Artificial Sequence
  Peptide Derived from Human Papillomavirus
NTTPIVHLK

SEQ ID NO: 39999 - protein, 10 aa, Artificial Sequence
  Peptide Derived from Human Papillomavirus
NVCQDKILTH

SEQ ID NO: 40000 - protein, 11 aa, Artificial Sequence
  Peptide Derived from Human Papillomavirus
NVCQDKILTHY

SEQ ID NO: 40001 - protein, 9 aa, Artificial Sequence
  Peptide Derived from Human Papillomavirus
PCHTTKLLH

SEQ ID NO: 40002 - protein, 10 aa, Artificial Sequence
  Peptide Derived from Human Papillomavirus
PCHTTKLLHR

SEQ ID NO: 40003 - protein, 8 aa, Artificial Sequence
  Peptide Derived from Human Papillomavirus
PDTGNPCH

SEQ ID NO: 40004 - protein, 11 aa, Artificial Sequence
  Peptide Derived from Human Papillomavirus
PDTGNPCHTTK

SEQ ID NO: 40005 - protein, 10 aa, Artificial Sequence
  Peptide Derived from Human Papillomavirus
PILTAFNSSH

SEQ ID NO: 40006 - protein, 11 aa, Artificial Sequence
  Peptide Derived from Human Papillomavirus
PILTAFNSSHK

SEQ ID NO: 40007 - protein, 8 aa, Artificial Sequence
  Peptide Derived from Human Papillomavirus
PTGCIKKH

SEQ ID NO: 40008 - protein, 10 aa, Artificial Sequence
  Peptide Derived from Human Papillomavirus
PTGCIKKHGY

SEQ ID NO: 40009 - protein, 9 aa, Artificial Sequence
  Peptide Derived from Human Papillomavirus
PTLAVSKNK

SEQ ID NO: 40010 - protein, 8 aa, Artificial Sequence
  Peptide Derived from Human Papillomavirus
QDKILTHY

SEQ ID NO: 40011 - protein, 8 aa, Artificial Sequence
  Peptide Derived from Human Papillomavirus
QDVSLEVY

SEQ ID NO: 40012 - protein, 11 aa, Artificial Sequence
  Peptide Derived from Human Papillomavirus
QFDGDICNTMH

SEQ ID NO: 40013 - protein, 8 aa, Artificial Sequence
  Peptide Derived from Human Papillomavirus
QFKDDAEK

SEQ ID NO: 40014 - protein, 9 aa, Artificial Sequence
  Peptide Derived from Human Papillomavirus
QFKDDAEKY

SEQ ID NO: 40015 - protein, 11 aa, Artificial Sequence
  Peptide Derived from Human Papillomavirus
QFKDDAEKYSK

SEQ ID NO: 40016 - protein, 10 aa, Artificial Sequence
  Peptide Derived from Human Papillomavirus
QFLSQVKIPK

SEQ ID NO: 40017 - protein, 8 aa, Artificial Sequence
  Peptide Derived from Human Papillomavirus
QLTLETIY

SEQ ID NO: 40018 - protein, 8 aa, Artificial Sequence
  Peptide Derived from Human Papillomavirus
QTTIQRPR

SEQ ID NO: 40019 - protein, 8 aa, Artificial Sequence
  Peptide Derived from Human Papillomavirus
QVDYYGLY

SEQ ID NO: 40020 - protein, 9 aa, Artificial Sequence
  Peptide Derived from Human Papillomavirus
QVDYYGLYY

SEQ ID NO: 40021 - protein, 11 aa, Artificial Sequence
  Peptide Derived from Human Papillomavirus
QVDYYGLYYVH

SEQ ID NO: 40022 - protein, 10 aa, Artificial Sequence
  Peptide Derived from Human Papillomavirus
QVVPTLAVSK

SEQ ID NO: 40023 - protein, 8 aa, Artificial Sequence
  Peptide Derived from Human Papillomavirus
RDHIDYWK

SEQ ID NO: 40024 - protein, 9 aa, Artificial Sequence
  Peptide Derived from Human Papillomavirus
RDHIDYWKH

SEQ ID NO: 40025 - protein, 11 aa, Artificial Sequence
  Peptide Derived from Human Papillomavirus
RDHIDYWKHMR

SEQ ID NO: 40026 - protein, 9 aa, Artificial Sequence
  Peptide Derived from Human Papillomavirus
RDQFLSQVK

SEQ ID NO: 40027 - protein, 9 aa, Artificial Sequence
  Peptide Derived from Human Papillomavirus
RFKKHCTLY

SEQ ID NO: 40028 - protein, 8 aa, Artificial Sequence
  Peptide Derived from Human Papillomavirus
RLECAIYY

SEQ ID NO: 40029 - protein, 9 aa, Artificial Sequence
  Peptide Derived from Human Papillomavirus
RLECAIYYK

SEQ ID NO: 40030 - protein, 11 aa, Artificial Sequence
  Peptide Derived from Human Papillomavirus
RLECAIYYKAR

SEQ ID NO: 40031 - protein, 8 aa, Artificial Sequence
  Peptide Derived from Human Papillomavirus
RLNVCQDK

SEQ ID NO: 40032 - protein, 11 aa, Artificial Sequence
  Peptide Derived from Human Papillomavirus
RSEPDTGNPCH

SEQ ID NO: 40033 - protein, 8 aa, Artificial Sequence
  Peptide Derived from Human Papillomavirus
RTYFVQFK

SEQ ID NO: 40034 - protein, 8 aa, Artificial Sequence
  Peptide Derived from Human Papillomavirus
SAIVTLTY

SEQ ID NO: 40035 - protein, 11 aa, Artificial Sequence
  Peptide Derived from Human Papillomavirus
SNEVSSPEIIR

SEQ ID NO: 40036 - protein, 8 aa, Artificial Sequence
  Peptide Derived from Human Papillomavirus
SNTTPIVH

SEQ ID NO: 40037 - protein, 10 aa, Artificial Sequence
  Peptide Derived from Human Papillomavirus
SNTTPIVHLK

SEQ ID NO: 40038 - protein, 9 aa, Artificial Sequence
  Peptide Derived from Human Papillomavirus
SSPEIIRQH

SEQ ID NO: 40039 - protein, 9 aa, Artificial Sequence
  Peptide Derived from Human Papillomavirus
SSTWHWTGH

SEQ ID NO: 40040 - protein, 10 aa, Artificial Sequence
  Peptide Derived from Human Papillomavirus
STDLRDHIDY

SEQ ID NO: 40041 - protein, 8 aa, Artificial Sequence
  Peptide Derived from Human Papillomavirus
STWHWTGH

SEQ ID NO: 40042 - protein, 11 aa, Artificial Sequence
  Peptide Derived from Human Papillomavirus
STWHWTGHNVK

SEQ ID NO: 40043 - protein, 11 aa, Artificial Sequence
  Peptide Derived from Human Papillomavirus
SVTVVEGQVDY

SEQ ID NO: 40044 - protein, 8 aa, Artificial Sequence
  Peptide Derived from Human Papillomavirus
TAFNSSHK

SEQ ID NO: 40045 - protein, 10 aa, Artificial Sequence
  Peptide Derived from Human Papillomavirus
TAFNSSHKGR

SEQ ID NO: 40046 - protein, 8 aa, Artificial Sequence
  Peptide Derived from Human Papillomavirus
TAPTGCIK

SEQ ID NO: 40047 - protein, 9 aa, Artificial Sequence
  Peptide Derived from Human Papillomavirus
TAPTGCIKK

SEQ ID NO: 40048 - protein, 10 aa, Artificial Sequence
  Peptide Derived from Human Papillomavirus
TAPTGCIKKH

SEQ ID NO: 40049 - protein, 8 aa, Artificial Sequence
  Peptide Derived from Human Papillomavirus
TAVSSTWH

SEQ ID NO: 40050 - protein, 9 aa, Artificial Sequence
  Peptide Derived from Human Papillomavirus
TDLRDHIDY

SEQ ID NO: 40051 - protein, 11 aa, Artificial Sequence
  Peptide Derived from Human Papillomavirus
TDLRDHIDYWK

SEQ ID NO: 40052 - protein, 9 aa, Artificial Sequence
  Peptide Derived from Human Papillomavirus
TGCIKKHGY

SEQ ID NO: 40053 - protein, 8 aa, Artificial Sequence
  Peptide Derived from Human Papillomavirus
TGHNVKHK

SEQ ID NO: 40054 - protein, 9 aa, Artificial Sequence
  Peptide Derived from Human Papillomavirus
TGNPCHTTK

SEQ ID NO: 40055 - protein, 11 aa, Artificial Sequence
  Peptide Derived from Human Papillomavirus
TIYNSQYSNEK

SEQ ID NO: 40056 - protein, 8 aa, Artificial Sequence
  Peptide Derived from Human Papillomavirus
TLAVSKNK

SEQ ID NO: 40057 - protein, 10 aa, Artificial Sequence
  Peptide Derived from Human Papillomavirus
TLETIYNSQY

SEQ ID NO: 40058 - protein, 8 aa, Artificial Sequence
  Peptide Derived from Human Papillomavirus
TLKCLRYR

SEQ ID NO: 40059 - protein, 10 aa, Artificial Sequence
  Peptide Derived from Human Papillomavirus
TLKCLRYRFK

SEQ ID NO: 40060 - protein, 11 aa, Artificial Sequence
  Peptide Derived from Human Papillomavirus
TLKCLRYRFKK

SEQ ID NO: 40061 - protein, 10 aa, Artificial Sequence
  Peptide Derived from Human Papillomavirus
TLQDVSLEVY

SEQ ID NO: 40062 - protein, 10 aa, Artificial Sequence
  Peptide Derived from Human Papillomavirus
TLTYDSEWQR

SEQ ID NO: 40063 - protein, 11 aa, Artificial Sequence
  Peptide Derived from Human Papillomavirus
TLYTAVSSTWH

SEQ ID NO: 40064 - protein, 9 aa, Artificial Sequence
  Peptide Derived from Human Papillomavirus
TMHYTNWTH

SEQ ID NO: 40065 - protein, 11 aa, Artificial Sequence
  Peptide Derived from Human Papillomavirus
TMHYTNWTHIY

SEQ ID NO: 40066 - protein, 8 aa, Artificial Sequence
  Peptide Derived from Human Papillomavirus
TTPIVHLK

SEQ ID NO: 40067 - protein, 9 aa, Artificial Sequence
  Peptide Derived from Human Papillomavirus
TVVEGQVDY

SEQ ID NO: 40068 - protein, 10 aa, Artificial Sequence
  Peptide Derived from Human Papillomavirus
TVVEGQVDYY

SEQ ID NO: 40069 - protein, 9 aa, Artificial Sequence
  Peptide Derived from Human Papillomavirus
VCQDKILTH

SEQ ID NO: 40070 - protein, 10 aa, Artificial Sequence
  Peptide Derived from Human Papillomavirus
VCQDKILTHY

SEQ ID NO: 40071 - protein, 8 aa, Artificial Sequence
  Peptide Derived from Human Papillomavirus
VDYYGLYY

SEQ ID NO: 40072 - protein, 10 aa, Artificial Sequence
  Peptide Derived from Human Papillomavirus
VDYYGLYYVH

SEQ ID NO: 40073 - protein, 8 aa, Artificial Sequence
  Peptide Derived from Human Papillomavirus
VSSPEIIR

SEQ ID NO: 40074 - protein, 10 aa, Artificial Sequence
  Peptide Derived from Human Papillomavirus
VSSPEIIRQH

SEQ ID NO: 40075 - protein, 10 aa, Artificial Sequence
  Peptide Derived from Human Papillomavirus
VSSTWHWTGH

SEQ ID NO: 40076 - protein, 11 aa, Artificial Sequence
  Peptide Derived from Human Papillomavirus
VTLTYDSEWQR

SEQ ID NO: 40077 - protein, 10 aa, Artificial Sequence
  Peptide Derived from Human Papillomavirus
VTVVEGQVDY

SEQ ID NO: 40078 - protein, 11 aa, Artificial Sequence
  Peptide Derived from Human Papillomavirus
VTVVEGQVDYY

SEQ ID NO: 40079 - protein, 8 aa, Artificial Sequence
  Peptide Derived from Human Papillomavirus
VVEGQVDY

SEQ ID NO: 40080 - protein, 9 aa, Artificial Sequence
  Peptide Derived from Human Papillomavirus
VVEGQVDYY

SEQ ID NO: 40081 - protein, 9 aa, Artificial Sequence
  Peptide Derived from Human Papillomavirus
VVPTLAVSK

SEQ ID NO: 40082 - protein, 11 aa, Artificial Sequence
  Peptide Derived from Human Papillomavirus
VVPTLAVSKNK

SEQ ID NO: 40083 - protein, 8 aa, Artificial Sequence
  Peptide Derived from Human Papillomavirus
WTGHNVKH

SEQ ID NO: 40084 - protein, 9 aa, Artificial Sequence
  Peptide Derived from Human Papillomavirus
WTGHNVKHK

SEQ ID NO: 40085 - protein, 11 aa, Artificial Sequence
  Peptide Derived from Human Papillomavirus
WTLQDVSLEVY

SEQ ID NO: 40086 - protein, 11 aa, Artificial Sequence
  Peptide Derived from Human Papillomavirus
YFVQFKDDAEK

SEQ ID NO: 40087 - protein, 11 aa, Artificial Sequence
  Peptide Derived from Human Papillomavirus
YGLYYVHEGIR

SEQ ID NO: 40088 - protein, 10 aa, Artificial Sequence
  Peptide Derived from Human Papillomavirus
YLTAPTGCIK

SEQ ID NO: 40089 - protein, 11 aa, Artificial Sequence
  Peptide Derived from Human Papillomavirus
YLTAPTGCIKK

SEQ ID NO: 40090 - protein, 9 aa, Artificial Sequence
  Peptide Derived from Human Papillomavirus
YNSQYSNEK

SEQ ID NO: 40091 - protein, 10 aa, Artificial Sequence
  Peptide Derived from Human Papillomavirus
YSKNKVWEVH

SEQ ID NO: 40092 - protein, 9 aa, Artificial Sequence
  Peptide Derived from Human Papillomavirus
YTAVSSTWH

SEQ ID NO: 40093 - protein, 8 aa, Artificial Sequence
  Peptide Derived from Human Papillomavirus
YTNWTHIY

SEQ ID NO: 40094 - protein, 9 aa, Artificial Sequence
  Peptide Derived from Human Papillomavirus
YVHEGIRTY

SEQ ID NO: 40095 - protein, 11 aa, Artificial Sequence
  Peptide Derived from Human Papillomavirus
AASAFRCFIVY

SEQ ID NO: 40096 - protein, 8 aa, Artificial Sequence
  Peptide Derived from Human Papillomavirus
AFRCFIVY

SEQ ID NO: 40097 - protein, 10 aa, Artificial Sequence
  Peptide Derived from Human Papillomavirus
ASAFRCFIVY

SEQ ID NO: 40098 - protein, 10 aa, Artificial Sequence
  Peptide Derived from Human Papillomavirus
CFIVYIIFVY

SEQ ID NO: 40099 - protein, 11 aa, Artificial Sequence
  Peptide Derived from Human Papillomavirus
CVLLCVCLLIR

SEQ ID NO: 40100 - protein, 9 aa, Artificial Sequence
  Peptide Derived from Human Papillomavirus
FIVYIIFVY

SEQ ID NO: 40101 - protein, 8 aa, Artificial Sequence
  Peptide Derived from Human Papillomavirus
FLIHTHAR

SEQ ID NO: 40102 - protein, 10 aa, Artificial Sequence
  Peptide Derived from Human Papillomavirus
FVYIPLFLIH

SEQ ID NO: 40103 - protein, 11 aa, Artificial Sequence
  Peptide Derived from Human Papillomavirus
IFVYIPLFLIH

SEQ ID NO: 40104 - protein, 8 aa, Artificial Sequence
  Peptide Derived from Human Papillomavirus
ITAASAFR

SEQ ID NO: 40105 - protein, 8 aa, Artificial Sequence
  Peptide Derived from Human Papillomavirus
IVYIIFVY

SEQ ID NO: 40106 - protein, 8 aa, Artificial Sequence
  Peptide Derived from Human Papillomavirus
LCVCLLIR

SEQ ID NO: 40107 - protein, 9 aa, Artificial Sequence
  Peptide Derived from Human Papillomavirus
LFLIHTHAR

SEQ ID NO: 40108 - protein, 9 aa, Artificial Sequence
  Peptide Derived from Human Papillomavirus
LLCVCLLIR

SEQ ID NO: 40109 - protein, 8 aa, Artificial Sequence
  Peptide Derived from Human Papillomavirus
LLLSVSTY

SEQ ID NO: 40110 - protein, 11 aa, Artificial Sequence
  Peptide Derived from Human Papillomavirus
LLWITAASAFR

SEQ ID NO: 40111 - protein, 8 aa, Artificial Sequence
  Peptide Derived from Human Papillomavirus
PLFLIHTH

SEQ ID NO: 40112 - protein, 10 aa, Artificial Sequence
  Peptide Derived from Human Papillomavirus
PLFLIHTHAR

SEQ ID NO: 40113 - protein, 9 aa, Artificial Sequence
  Peptide Derived from Human Papillomavirus
PLLLSVSTY

SEQ ID NO: 40114 - protein, 11 aa, Artificial Sequence
  Peptide Derived from Human Papillomavirus
RCFIVYIIFVY

SEQ ID NO: 40115 - protein, 9 aa, Artificial Sequence
  Peptide Derived from Human Papillomavirus
SAFRCFIVY

SEQ ID NO: 40116 - protein, 10 aa, Artificial Sequence
  Peptide Derived from Human Papillomavirus
VLLCVCLLIR

SEQ ID NO: 40117 - protein, 9 aa, Artificial Sequence
  Peptide Derived from Human Papillomavirus
WITAASAFR

SEQ ID NO: 40118 - protein, 8 aa, Artificial Sequence
  Peptide Derived from Human Papillomavirus
YIPLFLIH

SEQ ID NO: 40119 - protein, 10 aa, Artificial Sequence
  Peptide Derived from Human Papillomavirus
YIPLFLIHTH

SEQ ID NO: 40120 - protein, 9 aa, Artificial Sequence
  Peptide Derived from Human Papillomavirus
AFRDLCIVY

SEQ ID NO: 40121 - protein, 10 aa, Artificial Sequence
  Peptide Derived from Human Papillomavirus
AFRDLCIVYR

SEQ ID NO: 40122 - protein, 9 aa, Artificial Sequence
  Peptide Derived from Human Papillomavirus
AMFQDPQER

SEQ ID NO: 40123 - protein, 11 aa, Artificial Sequence
  Peptide Derived from Human Papillomavirus
AMFQDPQERPR

SEQ ID NO: 40124 - protein, 8 aa, Artificial Sequence
  Peptide Derived from Human Papillomavirus
AVCDKCLK

SEQ ID NO: 40125 - protein, 10 aa, Artificial Sequence
  Peptide Derived from Human Papillomavirus
AVCDKCLKFY

SEQ ID NO: 40126 - protein, 8 aa, Artificial Sequence
  Peptide Derived from Human Papillomavirus
CCRSSRTR

SEQ ID NO: 40127 - protein, 9 aa, Artificial Sequence
  Peptide Derived from Human Papillomavirus
CCRSSRTRR

SEQ ID NO: 40128 - protein, 8 aa, Artificial Sequence
  Peptide Derived from Human Papillomavirus
CDKCLKFY

SEQ ID NO: 40129 - protein, 10 aa, Artificial Sequence
  Peptide Derived from Human Papillomavirus
CDKCLKFYSK

SEQ ID NO: 40130 - protein, 10 aa, Artificial Sequence
  Peptide Derived from Human Papillomavirus
CIVYRDGNPY

SEQ ID NO: 40131 - protein, 11 aa, Artificial Sequence
  Peptide Derived from Human Papillomavirus
CLKFYSKISEY

SEQ ID NO: 40132 - protein, 9 aa, Artificial Sequence
  Peptide Derived from Human Papillomavirus
CMSCCRSSR

SEQ ID NO: 40133 - protein, 11 aa, Artificial Sequence
  Peptide Derived from Human Papillomavirus
CMSCCRSSRTR

SEQ ID NO: 40134 - protein, 9 aa, Artificial Sequence
  Peptide Derived from Human Papillomavirus
CTELQTTIH

SEQ ID NO: 40135 - protein, 10 aa, Artificial Sequence
  Peptide Derived from Human Papillomavirus
CVYCKQQLLR

SEQ ID NO: 40136 - protein, 11 aa, Artificial Sequence
  Peptide Derived from Human Papillomavirus
CVYCKQQLLRR

SEQ ID NO: 40137 - protein, 11 aa, Artificial Sequence
  Peptide Derived from Human Papillomavirus
DFAFRDLCIVY

SEQ ID NO: 40138 - protein, 10 aa, Artificial Sequence
  Peptide Derived from Human Papillomavirus
DGNPYAVCDK

SEQ ID NO: 40139 - protein, 8 aa, Artificial Sequence
  Peptide Derived from Human Papillomavirus
DIILECVY

SEQ ID NO: 40140 - protein, 10 aa, Artificial Sequence
  Peptide Derived from Human Papillomavirus
DIILECVYCK

SEQ ID NO: 40141 - protein, 11 aa, Artificial Sequence
  Peptide Derived from Human Papillomavirus
DLLIRCINCQK

SEQ ID NO: 40142 - protein, 11 aa, Artificial Sequence
  Peptide Derived from Human Papillomavirus
ECVYCKQQLLR

SEQ ID NO: 40143 - protein, 8 aa, Artificial Sequence
  Peptide Derived from Human Papillomavirus
EVYDFAFR

SEQ ID NO: 40144 - protein, 10 aa, Artificial Sequence
  Peptide Derived from Human Papillomavirus
FAFRDLCIVY

SEQ ID NO: 40145 - protein, 11 aa, Artificial Sequence
  Peptide Derived from Human Papillomavirus
FAFRDLCIVYR

SEQ ID NO: 40146 - protein, 9 aa, Artificial Sequence
  Peptide Derived from Human Papillomavirus
GNPYAVCDK

SEQ ID NO: 40147 - protein, 8 aa, Artificial Sequence
  Peptide Derived from Human Papillomavirus
GTTLEQQY

SEQ ID NO: 40148 - protein, 10 aa, Artificial Sequence
  Peptide Derived from Human Papillomavirus
GTTLEQQYNK

SEQ ID NO: 40149 - protein, 9 aa, Artificial Sequence
  Peptide Derived from Human Papillomavirus
HDIILECVY

SEQ ID NO: 40150 - protein, 11 aa, Artificial Sequence
  Peptide Derived from Human Papillomavirus
HDIILECVYCK

SEQ ID NO: 40151 - protein, 9 aa, Artificial Sequence
  Peptide Derived from Human Papillomavirus
HLDKKQRFH

SEQ ID NO: 40152 - protein, 10 aa, Artificial Sequence
  Peptide Derived from Human Papillomavirus
HNIRGRWTGR

SEQ ID NO: 40153 - protein, 9 aa, Artificial Sequence
  Peptide Derived from Human Papillomavirus
IILECVYCK

SEQ ID NO: 40154 - protein, 8 aa, Artificial Sequence
  Peptide Derived from Human Papillomavirus
ILECVYCK

SEQ ID NO: 40155 - protein, 9 aa, Artificial Sequence
  Peptide Derived from Human Papillomavirus
ISEYRHYCY

SEQ ID NO: 40156 - protein, 9 aa, Artificial Sequence
  Peptide Derived from Human Papillomavirus
IVYRDGNPY

SEQ ID NO: 40157 - protein, 8 aa, Artificial Sequence
  Peptide Derived from Human Papillomavirus
KCLKFYSK

SEQ ID NO: 40158 - protein, 9 aa, Artificial Sequence
  Peptide Derived from Human Papillomavirus
KFYSKISEY

SEQ ID NO: 40159 - protein, 10 aa, Artificial Sequence
  Peptide Derived from Human Papillomavirus
KFYSKISEYR

SEQ ID NO: 40160 - protein, 11 aa, Artificial Sequence
  Peptide Derived from Human Papillomavirus
KFYSKISEYRH

SEQ ID NO: 40161 - protein, 8 aa, Artificial Sequence
  Peptide Derived from Human Papillomavirus
KISEYRHY

SEQ ID NO: 40162 - protein, 10 aa, Artificial Sequence
  Peptide Derived from Human Papillomavirus
KISEYRHYCY

SEQ ID NO: 40163 - protein, 11 aa, Artificial Sequence
  Peptide Derived from Human Papillomavirus
LCIVYRDGNPY

SEQ ID NO: 40164 - protein, 8 aa, Artificial Sequence
  Peptide Derived from Human Papillomavirus
LCPEEKQR

SEQ ID NO: 40165 - protein, 9 aa, Artificial Sequence
  Peptide Derived from Human Papillomavirus
LCPEEKQRH

SEQ ID NO: 40166 - protein, 10 aa, Artificial Sequence
  Peptide Derived from Human Papillomavirus
LCTELQTTIH

SEQ ID NO: 40167 - protein, 8 aa, Artificial Sequence
  Peptide Derived from Human Papillomavirus
LDKKQRFH

SEQ ID NO: 40168 - protein, 11 aa, Artificial Sequence
  Peptide Derived from Human Papillomavirus
LDKKQRFHNIR

SEQ ID NO: 40169 - protein, 9 aa, Artificial Sequence
  Peptide Derived from Human Papillomavirus
LIRCINCQK

SEQ ID NO: 40170 - protein, 10 aa, Artificial Sequence
  Peptide Derived from Human Papillomavirus
LLIRCINCQK

SEQ ID NO: 40171 - protein, 8 aa, Artificial Sequence
  Peptide Derived from Human Papillomavirus
MFQDPQER

SEQ ID NO: 40172 - protein, 10 aa, Artificial Sequence
  Peptide Derived from Human Papillomavirus
MFQDPQERPR

SEQ ID NO: 40173 - protein, 11 aa, Artificial Sequence
  Peptide Derived from Human Papillomavirus
MFQDPQERPRK

SEQ ID NO: 40174 - protein, 8 aa, Artificial Sequence
  Peptide Derived from Human Papillomavirus
MSCCRSSR

SEQ ID NO: 40175 - protein, 10 aa, Artificial Sequence
  Peptide Derived from Human Papillomavirus
MSCCRSSRTR

SEQ ID NO: 40176 - protein, 11 aa, Artificial Sequence
  Peptide Derived from Human Papillomavirus
MSCCRSSRTRR

SEQ ID NO: 40177 - protein, 11 aa, Artificial Sequence
  Peptide Derived from Human Papillomavirus
NCQKPLCPEEK

SEQ ID NO: 40178 - protein, 9 aa, Artificial Sequence
  Peptide Derived from Human Papillomavirus
NIRGRWTGR

SEQ ID NO: 40179 - protein, 8 aa, Artificial Sequence
  Peptide Derived from Human Papillomavirus
PLCDLLIR

SEQ ID NO: 40180 - protein, 9 aa, Artificial Sequence
  Peptide Derived from Human Papillomavirus
PLCPEEKQR

SEQ ID NO: 40181 - protein, 10 aa, Artificial Sequence
  Peptide Derived from Human Papillomavirus
PLCPEEKQRH

SEQ ID NO: 40182 - protein, 8 aa, Artificial Sequence
  Peptide Derived from Human Papillomavirus
QDPQERPR

SEQ ID NO: 40183 - protein, 9 aa, Artificial Sequence
  Peptide Derived from Human Papillomavirus
QDPQERPRK

SEQ ID NO: 40184 - protein, 11 aa, Artificial Sequence
  Peptide Derived from Human Papillomavirus
QLCTELQTTIH

SEQ ID NO: 40185 - protein, 8 aa, Artificial Sequence
  Peptide Derived from Human Papillomavirus
QLLRREVY

SEQ ID NO: 40186 - protein, 10 aa, Artificial Sequence
  Peptide Derived from Human Papillomavirus
RCMSCCRSSR

SEQ ID NO: 40187 - protein, 11 aa, Artificial Sequence
  Peptide Derived from Human Papillomavirus
RDGNPYAVCDK

SEQ ID NO: 40188 - protein, 8 aa, Artificial Sequence
  Peptide Derived from Human Papillomavirus
RDLCIVYR

SEQ ID NO: 40189 - protein, 8 aa, Artificial Sequence
  Peptide Derived from Human Papillomavirus
RFHNIRGR

SEQ ID NO: 40190 - protein, 11 aa, Artificial Sequence
  Peptide Derived from Human Papillomavirus
RTAMFQDPQER

SEQ ID NO: 40191 - protein, 9 aa, Artificial Sequence
  Peptide Derived from Human Papillomavirus
SCCRSSRTR

SEQ ID NO: 40192 - protein, 10 aa, Artificial Sequence
  Peptide Derived from Human Papillomavirus
SCCRSSRTRR

SEQ ID NO: 40193 - protein, 11 aa, Artificial Sequence
  Peptide Derived from Human Papillomavirus
SLYGTTLEQQY

SEQ ID NO: 40194 - protein, 10 aa, Artificial Sequence
  Peptide Derived from Human Papillomavirus
TAMFQDPQER

SEQ ID NO: 40195 - protein, 9 aa, Artificial Sequence
  Peptide Derived from Human Papillomavirus
TGRCMSCCR

SEQ ID NO: 40196 - protein, 11 aa, Artificial Sequence
  Peptide Derived from Human Papillomavirus
TIHDIILECVY

SEQ ID NO: 40197 - protein, 8 aa, Artificial Sequence
  Peptide Derived from Human Papillomavirus
TLEQQYNK

SEQ ID NO: 40198 - protein, 9 aa, Artificial Sequence
  Peptide Derived from Human Papillomavirus
TTLEQQYNK

SEQ ID NO: 40199 - protein, 9 aa, Artificial Sequence
  Peptide Derived from Human Papillomavirus
VCDKCLKFY

SEQ ID NO: 40200 - protein, 11 aa, Artificial Sequence
  Peptide Derived from Human Papillomavirus
VCDKCLKFYSK

SEQ ID NO: 40201 - protein, 10 aa, Artificial Sequence
  Peptide Derived from Human Papillomavirus
WTGRCMSCCR

SEQ ID NO: 40202 - protein, 9 aa, Artificial Sequence
  Peptide Derived from Human Papillomavirus
YAVCDKCLK

SEQ ID NO: 40203 - protein, 11 aa, Artificial Sequence
  Peptide Derived from Human Papillomavirus
YAVCDKCLKFY

SEQ ID NO: 40204 - protein, 8 aa, Artificial Sequence
  Peptide Derived from Human Papillomavirus
YCKQQLLR

SEQ ID NO: 40205 - protein, 9 aa, Artificial Sequence
  Peptide Derived from Human Papillomavirus
YCKQQLLRR

SEQ ID NO: 40206 - protein, 9 aa, Artificial Sequence
  Peptide Derived from Human Papillomavirus
YGTTLEQQY

SEQ ID NO: 40207 - protein, 11 aa, Artificial Sequence
  Peptide Derived from Human Papillomavirus
YGTTLEQQYNK

SEQ ID NO: 40208 - protein, 11 aa, Artificial Sequence
  Peptide Derived from Human Papillomavirus
YNKPLCDLLIR

SEQ ID NO: 40209 - protein, 8 aa, Artificial Sequence
  Peptide Derived from Human Papillomavirus
YSKISEYR

SEQ ID NO: 40210 - protein, 9 aa, Artificial Sequence
  Peptide Derived from Human Papillomavirus
YSKISEYRH

SEQ ID NO: 40211 - protein, 10 aa, Artificial Sequence
  Peptide Derived from Human Papillomavirus
YSKISEYRHY

SEQ ID NO: 40212 - protein, 8 aa, Artificial Sequence
  Peptide Derived from Human Papillomavirus
AGQAEPDR

SEQ ID NO: 40213 - protein, 10 aa, Artificial Sequence
  Peptide Derived from Human Papillomavirus
AGQAEPDRAH

SEQ ID NO: 40214 - protein, 11 aa, Artificial Sequence
  Peptide Derived from Human Papillomavirus
AGQAEPDRAHY

SEQ ID NO: 40215 - protein, 9 aa, Artificial Sequence
  Peptide Derived from Human Papillomavirus
CCKCDSTLR

SEQ ID NO: 40216 - protein, 10 aa, Artificial Sequence
  Peptide Derived from Human Papillomavirus
CVQSTHVDIR

SEQ ID NO: 40217 - protein, 11 aa, Artificial Sequence
  Peptide Derived from Human Papillomavirus
DGPAGQAEPDR

SEQ ID NO: 40218 - protein, 10 aa, Artificial Sequence
  Peptide Derived from Human Papillomavirus
DLQPETTDLY

SEQ ID NO: 40219 - protein, 8 aa, Artificial Sequence
  Peptide Derived from Human Papillomavirus
DTPTLHEY

SEQ ID NO: 40220 - protein, 8 aa, Artificial Sequence
  Peptide Derived from Human Papillomavirus
ETTDLYCY

SEQ ID NO: 40221 - protein, 10 aa, Artificial Sequence
  Peptide Derived from Human Papillomavirus
FCCKCDSTLR

SEQ ID NO: 40222 - protein, 9 aa, Artificial Sequence
  Peptide Derived from Human Papillomavirus
GDTPTLHEY

SEQ ID NO: 40223 - protein, 10 aa, Artificial Sequence
  Peptide Derived from Human Papillomavirus
GIVCPICSQK

SEQ ID NO: 40224 - protein, 8 aa, Artificial Sequence
  Peptide Derived from Human Papillomavirus
HGDTPTLH

SEQ ID NO: 40225 - protein, 10 aa, Artificial Sequence
  Peptide Derived from Human Papillomavirus
HGDTPTLHEY

SEQ ID NO: 40226 - protein, 9 aa, Artificial Sequence
  Peptide Derived from Human Papillomavirus
IVCPICSQK

SEQ ID NO: 40227 - protein, 11 aa, Artificial Sequence
  Peptide Derived from Human Papillomavirus
LCVQSTHVDIR

SEQ ID NO: 40228 - protein, 11 aa, Artificial Sequence
  Peptide Derived from Human Papillomavirus
LDLQPETTDLY

SEQ ID NO: 40229 - protein, 11 aa, Artificial Sequence
  Peptide Derived from Human Papillomavirus
LGIVCPICSQK

SEQ ID NO: 40230 - protein, 8 aa, Artificial Sequence
  Peptide Derived from Human Papillomavirus
NIVTFCCK

SEQ ID NO: 40231 - protein, 9 aa, Artificial Sequence
  Peptide Derived from Human Papillomavirus
PAGQAEPDR

SEQ ID NO: 40232 - protein, 11 aa, Artificial Sequence
  Peptide Derived from Human Papillomavirus
PAGQAEPDRAH

SEQ ID NO: 40233 - protein, 8 aa, Artificial Sequence
  Peptide Derived from Human Papillomavirus
QAEPDRAH

SEQ ID NO: 40234 - protein, 9 aa, Artificial Sequence
  Peptide Derived from Human Papillomavirus
QAEPDRAHY

SEQ ID NO: 40235 - protein, 8 aa, Artificial Sequence
  Peptide Derived from Human Papillomavirus
QSTHVDIR

SEQ ID NO: 40236 - protein, 8 aa, Artificial Sequence
  Peptide Derived from Human Papillomavirus
RLCVQSTH

SEQ ID NO: 40237 - protein, 11 aa, Artificial Sequence
  Peptide Derived from Human Papillomavirus
STLRLCVQSTH

SEQ ID NO: 40238 - protein, 11 aa, Artificial Sequence
  Peptide Derived from Human Papillomavirus
TFCCKCDSTLR

SEQ ID NO: 40239 - protein, 10 aa, Artificial Sequence
  Peptide Derived from Human Papillomavirus
TLRLCVQSTH

SEQ ID NO: 40240 - protein, 8 aa, Artificial Sequence
  Peptide Derived from Human Papillomavirus
VCPICSQK

SEQ ID NO: 40241 - protein, 9 aa, Artificial Sequence
  Peptide Derived from Human Papillomavirus
YNIVTFCCK

SEQ ID NO: 40242 - protein, 10 aa, Artificial Sequence
  Peptide Derived from Human Papillomavirus
AAISTSETTY

SEQ ID NO: 40243 - protein, 11 aa, Artificial Sequence
  Peptide Derived from Human Papillomavirus
AAISTSETTYK

SEQ ID NO: 40244 - protein, 9 aa, Artificial Sequence
  Peptide Derived from Human Papillomavirus
AANAGVDNR

SEQ ID NO: 40245 - protein, 11 aa, Artificial Sequence
  Peptide Derived from Human Papillomavirus
ACQKHTPPAPK

SEQ ID NO: 40246 - protein, 9 aa, Artificial Sequence
  Peptide Derived from Human Papillomavirus
ACVGVEVGR

SEQ ID NO: 40247 - protein, 10 aa, Artificial Sequence
  Peptide Derived from Human Papillomavirus
ADLDQFPLGR

SEQ ID NO: 40248 - protein, 11 aa, Artificial Sequence
  Peptide Derived from Human Papillomavirus
ADLDQFPLGRK

SEQ ID NO: 40249 - protein, 8 aa, Artificial Sequence
  Peptide Derived from Human Papillomavirus
ADVMTYIH

SEQ ID NO: 40250 - protein, 8 aa, Artificial Sequence
  Peptide Derived from Human Papillomavirus
AGLKAKPK

SEQ ID NO: 40251 - protein, 11 aa, Artificial Sequence
  Peptide Derived from Human Papillomavirus
AGTSRLLAVGH

SEQ ID NO: 40252 - protein, 9 aa, Artificial Sequence
  Peptide Derived from Human Papillomavirus
AISTSETTY

SEQ ID NO: 40253 - protein, 10 aa, Artificial Sequence
  Peptide Derived from Human Papillomavirus
AISTSETTYK

SEQ ID NO: 40254 - protein, 11 aa, Artificial Sequence
  Peptide Derived from Human Papillomavirus
AMDFTTLQANK

SEQ ID NO: 40255 - protein, 8 aa, Artificial Sequence
  Peptide Derived from Human Papillomavirus
ANAGVDNR

SEQ ID NO: 40256 - protein, 8 aa, Artificial Sequence
  Peptide Derived from Human Papillomavirus
ANLASSNY

SEQ ID NO: 40257 - protein, 11 aa, Artificial Sequence
  Peptide Derived from Human Papillomavirus
AVGENVPDDLY

SEQ ID NO: 40258 - protein, 10 aa, Artificial Sequence
  Peptide Derived from Human Papillomavirus
AVGHPYFPIK

SEQ ID NO: 40259 - protein, 11 aa, Artificial Sequence
  Peptide Derived from Human Papillomavirus
AVGHPYFPIKK

SEQ ID NO: 40260 - protein, 11 aa, Artificial Sequence
  Peptide Derived from Human Papillomavirus
CAAISTSETTY

SEQ ID NO: 40261 - protein, 10 aa, Artificial Sequence
  Peptide Derived from Human Papillomavirus
CTSICKYPDY

SEQ ID NO: 40262 - protein, 8 aa, Artificial Sequence
  Peptide Derived from Human Papillomavirus
CVGVEVGR

SEQ ID NO: 40263 - protein, 9 aa, Artificial Sequence
  Peptide Derived from Human Papillomavirus
DAQIFNKPY

SEQ ID NO: 40264 - protein, 9 aa, Artificial Sequence
  Peptide Derived from Human Papillomavirus
DDTENASAY

SEQ ID NO: 40265 - protein, 9 aa, Artificial Sequence
  Peptide Derived from Human Papillomavirus
DFTTLQANK

SEQ ID NO: 40266 - protein, 8 aa, Artificial Sequence
  Peptide Derived from Human Papillomavirus
DICTSICK

SEQ ID NO: 40267 - protein, 9 aa, Artificial Sequence
  Peptide Derived from Human Papillomavirus
DICTSICKY

SEQ ID NO: 40268 - protein, 9 aa, Artificial Sequence
  Peptide Derived from Human Papillomavirus
DLDQFPLGR

SEQ ID NO: 40269 - protein, 10 aa, Artificial Sequence
  Peptide Derived from Human Papillomavirus
DLDQFPLGRK

SEQ ID NO: 40270 - protein, 10 aa, Artificial Sequence
  Peptide Derived from Human Papillomavirus
DLQFIFQLCK

SEQ ID NO: 40271 - protein, 10 aa, Artificial Sequence
  Peptide Derived from Human Papillomavirus
DNRECISMDY

SEQ ID NO: 40272 - protein, 11 aa, Artificial Sequence
  Peptide Derived from Human Papillomavirus
DNRECISMDYK

SEQ ID NO: 40273 - protein, 8 aa, Artificial Sequence
  Peptide Derived from Human Papillomavirus
DSLFFYLR

SEQ ID NO: 40274 - protein, 9 aa, Artificial Sequence
  Peptide Derived from Human Papillomavirus
DSLFFYLRR

SEQ ID NO: 40275 - protein, 8 aa, Artificial Sequence
  Peptide Derived from Human Papillomavirus
DTENASAY

SEQ ID NO: 40276 - protein, 11 aa, Artificial Sequence
  Peptide Derived from Human Papillomavirus
DTSFYNPDTQR

SEQ ID NO: 40277 - protein, 8 aa, Artificial Sequence
  Peptide Derived from Human Papillomavirus
ECISMDYK

SEQ ID NO: 40278 - protein, 8 aa, Artificial Sequence
  Peptide Derived from Human Papillomavirus
ENDVNVYH

SEQ ID NO: 40279 - protein, 8 aa, Artificial Sequence
  Peptide Derived from Human Papillomavirus
ENVPDDLY

SEQ ID NO: 40280 - protein, 10 aa, Artificial Sequence
  Peptide Derived from Human Papillomavirus
ENVPDDLYIK

SEQ ID NO: 40281 - protein, 10 aa, Artificial Sequence
  Peptide Derived from Human Papillomavirus
ETTYKNTNFK

SEQ ID NO: 40282 - protein, 9 aa, Artificial Sequence
  Peptide Derived from Human Papillomavirus
FGFPDTSFY

SEQ ID NO: 40283 - protein, 10 aa, Artificial Sequence
  Peptide Derived from Human Papillomavirus
FIYILVITCY

SEQ ID NO: 40284 - protein, 8 aa, Artificial Sequence
  Peptide Derived from Human Papillomavirus
FLLQAGLK

SEQ ID NO: 40285 - protein, 10 aa, Artificial Sequence
  Peptide Derived from Human Papillomavirus
FLLQAGLKAK

SEQ ID NO: 40286 - protein, 9 aa, Artificial Sequence
  Peptide Derived from Human Papillomavirus
FNKPYWLQR

SEQ ID NO: 40287 - protein, 8 aa, Artificial Sequence
  Peptide Derived from Human Papillomavirus
FTTLQANK

SEQ ID NO: 40288 - protein, 8 aa, Artificial Sequence
  Peptide Derived from Human Papillomavirus
FVRHLFNR

SEQ ID NO: 40289 - protein, 11 aa, Artificial Sequence
  Peptide Derived from Human Papillomavirus
FVTSQAIACQK

SEQ ID NO: 40290 - protein, 9 aa, Artificial Sequence
  Peptide Derived from Human Papillomavirus
FVTVVDTTR

SEQ ID NO: 40291 - protein, 9 aa, Artificial Sequence
  Peptide Derived from Human Papillomavirus
GCKPPIGEH

SEQ ID NO: 40292 - protein, 9 aa, Artificial Sequence
  Peptide Derived from Human Papillomavirus
GDSLFFYLR

SEQ ID NO: 40293 - protein, 10 aa, Artificial Sequence
  Peptide Derived from Human Papillomavirus
GDSLFFYLRR

SEQ ID NO: 40294 - protein, 8 aa, Artificial Sequence
  Peptide Derived from Human Papillomavirus
GFPDTSFY

SEQ ID NO: 40295 - protein, 8 aa, Artificial Sequence
  Peptide Derived from Human Papillomavirus
GGTLEDTY

SEQ ID NO: 40296 - protein, 9 aa, Artificial Sequence
  Peptide Derived from Human Papillomavirus
GGTLEDTYR

SEQ ID NO: 40297 - protein, 10 aa, Artificial Sequence
  Peptide Derived from Human Papillomavirus
GISGHPLLNK

SEQ ID NO: 40298 - protein, 8 aa, Artificial Sequence
  Peptide Derived from Human Papillomavirus
GLQYRVFR

SEQ ID NO: 40299 - protein, 10 aa, Artificial Sequence
  Peptide Derived from Human Papillomavirus
GLQYRVFRIH

SEQ ID NO: 40300 - protein, 11 aa, Artificial Sequence
  Peptide Derived from Human Papillomavirus
GSTANLASSNY

SEQ ID NO: 40301 - protein, 8 aa, Artificial Sequence
  Peptide Derived from Human Papillomavirus
GTLEDTYR

SEQ ID NO: 40302 - protein, 10 aa, Artificial Sequence
  Peptide Derived from Human Papillomavirus
GTSRLLAVGH

SEQ ID NO: 40303 - protein, 9 aa, Artificial Sequence
  Peptide Derived from Human Papillomavirus
ICKYPDYIK

SEQ ID NO: 40304 - protein, 8 aa, Artificial Sequence
  Peptide Derived from Human Papillomavirus
ICTSICKY

SEQ ID NO: 40305 - protein, 11 aa, Artificial Sequence
  Peptide Derived from Human Papillomavirus
ICTSICKYPDY

SEQ ID NO: 40306 - protein, 10 aa, Artificial Sequence
  Peptide Derived from Human Papillomavirus
IFNKPYWLQR

SEQ ID NO: 40307 - protein, 10 aa, Artificial Sequence
  Peptide Derived from Human Papillomavirus
IGCKPPIGEH

SEQ ID NO: 40308 - protein, 11 aa, Artificial Sequence
  Peptide Derived from Human Papillomavirus
ILVPKVSGLQY

SEQ ID NO: 40309 - protein, 9 aa, Artificial Sequence
  Peptide Derived from Human Papillomavirus
ISGHPLLNK

SEQ ID NO: 40310 - protein, 8 aa, Artificial Sequence
  Peptide Derived from Human Papillomavirus
ISTSETTY

SEQ ID NO: 40311 - protein, 9 aa, Artificial Sequence
  Peptide Derived from Human Papillomavirus
ISTSETTYK

SEQ ID NO: 40312 - protein, 11 aa, Artificial Sequence
  Peptide Derived from Human Papillomavirus
ITCYENDVNVY

SEQ ID NO: 40313 - protein, 10 aa, Artificial Sequence
  Peptide Derived from Human Papillomavirus
ITLTADVMTY

SEQ ID NO: 40314 - protein, 10 aa, Artificial Sequence
  Peptide Derived from Human Papillomavirus
KAKPKFTLGK

SEQ ID NO: 40315 - protein, 11 aa, Artificial Sequence
  Peptide Derived from Human Papillomavirus
KAKPKFTLGKR

SEQ ID NO: 40316 - protein, 10 aa, Artificial Sequence
  Peptide Derived from Human Papillomavirus
KFGFPDTSFY

SEQ ID NO: 40317 - protein, 9 aa, Artificial Sequence
  Peptide Derived from Human Papillomavirus
KFLLQAGLK

SEQ ID NO: 40318 - protein, 11 aa, Artificial Sequence
  Peptide Derived from Human Papillomavirus
KFLLQAGLKAK

SEQ ID NO: 40319 - protein, 8 aa, Artificial Sequence
  Peptide Derived from Human Papillomavirus
KFTLGKRK

SEQ ID NO: 40320 - protein, 11 aa, Artificial Sequence
  Peptide Derived from Human Papillomavirus
KITLTADVMTY

SEQ ID NO: 40321 - protein, 11 aa, Artificial Sequence
  Peptide Derived from Human Papillomavirus
KLDDTENASAY

SEQ ID NO: 40322 - protein, 8 aa, Artificial Sequence
  Peptide Derived from Human Papillomavirus
KNTNFKEY

SEQ ID NO: 40323 - protein, 10 aa, Artificial Sequence
  Peptide Derived from Human Papillomavirus
KNTNFKEYLR

SEQ ID NO: 40324 - protein, 11 aa, Artificial Sequence
  Peptide Derived from Human Papillomavirus
KNTNFKEYLRH

SEQ ID NO: 40325 - protein, 8 aa, Artificial Sequence
  Peptide Derived from Human Papillomavirus
KVSGLQYR

SEQ ID NO: 40326 - protein, 11 aa, Artificial Sequence
  Peptide Derived from Human Papillomavirus
KVSGLQYRVFR

SEQ ID NO: 40327 - protein, 8 aa, Artificial Sequence
  Peptide Derived from Human Papillomavirus
KVVSTDEY

SEQ ID NO: 40328 - protein, 11 aa, Artificial Sequence
  Peptide Derived from Human Papillomavirus
KVVSTDEYVAR

SEQ ID NO: 40329 - protein, 11 aa, Artificial Sequence
  Peptide Derived from Human Papillomavirus
LAVGHPYFPIK

SEQ ID NO: 40330 - protein, 10 aa, Artificial Sequence
  Peptide Derived from Human Papillomavirus
LDDTENASAY

SEQ ID NO: 40331 - protein, 9 aa, Artificial Sequence
  Peptide Derived from Human Papillomavirus
LDICTSICK

SEQ ID NO: 40332 - protein, 10 aa, Artificial Sequence
  Peptide Derived from Human Papillomavirus
LDICTSICKY

SEQ ID NO: 40333 - protein, 8 aa, Artificial Sequence
  Peptide Derived from Human Papillomavirus
LDQFPLGR

SEQ ID NO: 40334 - protein, 9 aa, Artificial Sequence
  Peptide Derived from Human Papillomavirus
LDQFPLGRK

SEQ ID NO: 40335 - protein, 10 aa, Artificial Sequence
  Peptide Derived from Human Papillomavirus
LFVTVVDTTR

SEQ ID NO: 40336 - protein, 8 aa, Artificial Sequence
  Peptide Derived from Human Papillomavirus
LGVGISGH

SEQ ID NO: 40337 - protein, 11 aa, Artificial Sequence
  Peptide Derived from Human Papillomavirus
LIGCKPPIGEH

SEQ ID NO: 40338 - protein, 8 aa, Artificial Sequence
  Peptide Derived from Human Papillomavirus
LLAVGHPY

SEQ ID NO: 40339 - protein, 9 aa, Artificial Sequence
  Peptide Derived from Human Papillomavirus
LLQAGLKAK

SEQ ID NO: 40340 - protein, 11 aa, Artificial Sequence
  Peptide Derived from Human Papillomavirus
LLQAGLKAKPK

SEQ ID NO: 40341 - protein, 8 aa, Artificial Sequence
  Peptide Derived from Human Papillomavirus
LTADVMTY

SEQ ID NO: 40342 - protein, 10 aa, Artificial Sequence
  Peptide Derived from Human Papillomavirus
LTADVMTYIH

SEQ ID NO: 40343 - protein, 10 aa, Artificial Sequence
  Peptide Derived from Human Papillomavirus
LVPKVSGLQY

SEQ ID NO: 40344 - protein, 11 aa, Artificial Sequence
  Peptide Derived from Human Papillomavirus
LVPKVSGLQYR

SEQ ID NO: 40345 - protein, 10 aa, Artificial Sequence
  Peptide Derived from Human Papillomavirus
MDFTTLQANK

SEQ ID NO: 40346 - protein, 9 aa, Artificial Sequence
  Peptide Derived from Human Papillomavirus
MFVRHLFNR

SEQ ID NO: 40347 - protein, 11 aa, Artificial Sequence
  Peptide Derived from Human Papillomavirus
MVTSDAQIFNK

SEQ ID NO: 40348 - protein, 8 aa, Artificial Sequence
  Peptide Derived from Human Papillomavirus
NFKEYLRH

SEQ ID NO: 40349 - protein, 10 aa, Artificial Sequence
  Peptide Derived from Human Papillomavirus
NIYYHAGTSR

SEQ ID NO: 40350 - protein, 8 aa, Artificial Sequence
  Peptide Derived from Human Papillomavirus
NNKILVPK

SEQ ID NO: 40351 - protein, 9 aa, Artificial Sequence
  Peptide Derived from Human Papillomavirus
NNNKILVPK

SEQ ID NO: 40352 - protein, 9 aa, Artificial Sequence
  Peptide Derived from Human Papillomavirus
NTNFKEYLR

SEQ ID NO: 40353 - protein, 10 aa, Artificial Sequence
  Peptide Derived from Human Papillomavirus
NTNFKEYLRH

SEQ ID NO: 40354 - protein, 9 aa, Artificial Sequence
  Peptide Derived from Human Papillomavirus
NVPDDLYIK

SEQ ID NO: 40355 - protein, 9 aa, Artificial Sequence
  Peptide Derived from Human Papillomavirus
PAPKEDPLK

SEQ ID NO: 40356 - protein, 10 aa, Artificial Sequence
  Peptide Derived from Human Papillomavirus
PAPKEDPLKK

SEQ ID NO: 40357 - protein, 11 aa, Artificial Sequence
  Peptide Derived from Human Papillomavirus
PAPKEDPLKKY

SEQ ID NO: 40358 - protein, 11 aa, Artificial Sequence
  Peptide Derived from Human Papillomavirus
PDYIKMVSEPY

SEQ ID NO: 40359 - protein, 9 aa, Artificial Sequence
  Peptide Derived from Human Papillomavirus
PGGTLEDTY

SEQ ID NO: 40360 - protein, 10 aa, Artificial Sequence
  Peptide Derived from Human Papillomavirus
PGGTLEDTYR

SEQ ID NO: 40361 - protein, 8 aa, Artificial Sequence
  Peptide Derived from Human Papillomavirus
PIGEHWGK

SEQ ID NO: 40362 - protein, 9 aa, Artificial Sequence
  Peptide Derived from Human Papillomavirus
PIKKPNNNK

SEQ ID NO: 40363 - protein, 10 aa, Artificial Sequence
  Peptide Derived from Human Papillomavirus
PLDICTSICK

SEQ ID NO: 40364 - protein, 11 aa, Artificial Sequence
  Peptide Derived from Human Papillomavirus
PLDICTSICKY

SEQ ID NO: 40365 - protein, 9 aa, Artificial Sequence
  Peptide Derived from Human Papillomavirus
PLGVGISGH

SEQ ID NO: 40366 - protein, 10 aa, Artificial Sequence
  Peptide Derived from Human Papillomavirus
PNNNKILVPK

SEQ ID NO: 40367 - protein, 11 aa, Artificial Sequence
  Peptide Derived from Human Papillomavirus
PTTSSTSTTAK

SEQ ID NO: 40368 - protein, 11 aa, Artificial Sequence
  Peptide Derived from Human Papillomavirus
PVSKVVSTDEY

SEQ ID NO: 40369 - protein, 9 aa, Artificial Sequence
  Peptide Derived from Human Papillomavirus
QAGLKAKPK

SEQ ID NO: 40370 - protein, 8 aa, Artificial Sequence
  Peptide Derived from Human Papillomavirus
QAIACQKH

SEQ ID NO: 40371 - protein, 8 aa, Artificial Sequence
  Peptide Derived from Human Papillomavirus
QFIFQLCK

SEQ ID NO: 40372 - protein, 11 aa, Artificial Sequence
  Peptide Derived from Human Papillomavirus
QIFNKPYWLQR

SEQ ID NO: 40373 - protein, 8 aa, Artificial Sequence
  Peptide Derived from Human Papillomavirus
QLCLIGCK

SEQ ID NO: 40374 - protein, 11 aa, Artificial Sequence
  Peptide Derived from Human Papillomavirus
QLFVTVVDTTR

SEQ ID NO: 40375 - protein, 10 aa, Artificial Sequence
  Peptide Derived from Human Papillomavirus
QMFVRHLFNR

SEQ ID NO: 40376 - protein, 10 aa, Artificial Sequence
  Peptide Derived from Human Papillomavirus
QTQLCLIGCK

SEQ ID NO: 40377 - protein, 9 aa, Artificial Sequence
  Peptide Derived from Human Papillomavirus
RIHLPDPNK

SEQ ID NO: 40378 - protein, 9 aa, Artificial Sequence
  Peptide Derived from Human Papillomavirus
RLLAVGHPY

SEQ ID NO: 40379 - protein, 11 aa, Artificial Sequence
  Peptide Derived from Human Papillomavirus
SADLDQFPLGR

SEQ ID NO: 40380 - protein, 8 aa, Artificial Sequence
  Peptide Derived from Human Papillomavirus
SDAQIFNK

SEQ ID NO: 40381 - protein, 10 aa, Artificial Sequence
  Peptide Derived from Human Papillomavirus
SDAQIFNKPY

SEQ ID NO: 40382 - protein, 9 aa, Artificial Sequence
  Peptide Derived from Human Papillomavirus
SFYNPDTQR

SEQ ID NO: 40383 - protein, 8 aa, Artificial Sequence
  Peptide Derived from Human Papillomavirus
SGHPLLNK

SEQ ID NO: 40384 - protein, 9 aa, Artificial Sequence
  Peptide Derived from Human Papillomavirus
SGLQYRVFR

SEQ ID NO: 40385 - protein, 11 aa, Artificial Sequence
  Peptide Derived from Human Papillomavirus
SGLQYRVFRIH

SEQ ID NO: 40386 - protein, 8 aa, Artificial Sequence
  Peptide Derived from Human Papillomavirus
SICKYPDY

SEQ ID NO: 40387 - protein, 10 aa, Artificial Sequence
  Peptide Derived from Human Papillomavirus
SICKYPDYIK

SEQ ID NO: 40388 - protein, 8 aa, Artificial Sequence
  Peptide Derived from Human Papillomavirus
SLFFYLRR

SEQ ID NO: 40389 - protein, 11 aa, Artificial Sequence
  Peptide Derived from Human Papillomavirus
SLWLPSEATVY

SEQ ID NO: 40390 - protein, 8 aa, Artificial Sequence
  Peptide Derived from Human Papillomavirus
SSTSTTAK

SEQ ID NO: 40391 - protein, 9 aa, Artificial Sequence
  Peptide Derived from Human Papillomavirus
SSTSTTAKR

SEQ ID NO: 40392 - protein, 10 aa, Artificial Sequence
  Peptide Derived from Human Papillomavirus
SSTSTTAKRK

SEQ ID NO: 40393 - protein, 11 aa, Artificial Sequence
  Peptide Derived from Human Papillomavirus
SSTSTTAKRKK

SEQ ID NO: 40394 - protein, 10 aa, Artificial Sequence
  Peptide Derived from Human Papillomavirus
STANLASSNY

SEQ ID NO: 40395 - protein, 8 aa, Artificial Sequence
  Peptide Derived from Human Papillomavirus
STDEYVAR

SEQ ID NO: 40396 - protein, 8 aa, Artificial Sequence
  Peptide Derived from Human Papillomavirus
STSETTYK

SEQ ID NO: 40397 - protein, 8 aa, Artificial Sequence
  Peptide Derived from Human Papillomavirus
STSTTAKR

SEQ ID NO: 40398 - protein, 9 aa, Artificial Sequence
  Peptide Derived from Human Papillomavirus
STSTTAKRK

SEQ ID NO: 40399 - protein, 10 aa, Artificial Sequence
  Peptide Derived from Human Papillomavirus
STSTTAKRKK

SEQ ID NO: 40400 - protein, 11 aa, Artificial Sequence
  Peptide Derived from Human Papillomavirus
STSTTAKRKKR

SEQ ID NO: 40401 - protein, 8 aa, Artificial Sequence
  Peptide Derived from Human Papillomavirus
STTAKRKK

SEQ ID NO: 40402 - protein, 9 aa, Artificial Sequence
  Peptide Derived from Human Papillomavirus
STTAKRKKR

SEQ ID NO: 40403 - protein, 10 aa, Artificial Sequence
  Peptide Derived from Human Papillomavirus
STTAKRKKRK

SEQ ID NO: 40404 - protein, 9 aa, Artificial Sequence
  Peptide Derived from Human Papillomavirus
TADVMTYIH

SEQ ID NO: 40405 - protein, 8 aa, Artificial Sequence
  Peptide Derived from Human Papillomavirus
TAKRKKRK

SEQ ID NO: 40406 - protein, 9 aa, Artificial Sequence
  Peptide Derived from Human Papillomavirus
TANLASSNY

SEQ ID NO: 40407 - protein, 10 aa, Artificial Sequence
  Peptide Derived from Human Papillomavirus
TCYENDVNVY

SEQ ID NO: 40408 - protein, 11 aa, Artificial Sequence
  Peptide Derived from Human Papillomavirus
TCYENDVNVYH

SEQ ID NO: 40409 - protein, 11 aa, Artificial Sequence
  Peptide Derived from Human Papillomavirus
TDEYVARTNIY

SEQ ID NO: 40410 - protein, 11 aa, Artificial Sequence
  Peptide Derived from Human Papillomavirus
TFIYILVITCY

SEQ ID NO: 40411 - protein, 8 aa, Artificial Sequence
  Peptide Derived from Human Papillomavirus
TFWEVNLK

SEQ ID NO: 40412 - protein, 10 aa, Artificial Sequence
  Peptide Derived from Human Papillomavirus
TFWEVNLKEK

SEQ ID NO: 40413 - protein, 9 aa, Artificial Sequence
  Peptide Derived from Human Papillomavirus
TLTADVMTY

SEQ ID NO: 40414 - protein, 11 aa, Artificial Sequence
  Peptide Derived from Human Papillomavirus
TLTADVMTYIH

SEQ ID NO: 40415 - protein, 8 aa, Artificial Sequence
  Peptide Derived from Human Papillomavirus
TNFKEYLR

SEQ ID NO: 40416 - protein, 9 aa, Artificial Sequence
  Peptide Derived from Human Papillomavirus
TNFKEYLRH

SEQ ID NO: 40417 - protein, 11 aa, Artificial Sequence
  Peptide Derived from Human Papillomavirus
TNIYYHAGTSR

SEQ ID NO: 40418 - protein, 9 aa, Artificial Sequence
  Peptide Derived from Human Papillomavirus
TSDAQIFNK

SEQ ID NO: 40419 - protein, 11 aa, Artificial Sequence
  Peptide Derived from Human Papillomavirus
TSDAQIFNKPY

SEQ ID NO: 40420 - protein, 10 aa, Artificial Sequence
  Peptide Derived from Human Papillomavirus
TSFYNPDTQR

SEQ ID NO: 40421 - protein, 9 aa, Artificial Sequence
  Peptide Derived from Human Papillomavirus
TSICKYPDY

SEQ ID NO: 40422 - protein, 11 aa, Artificial Sequence
  Peptide Derived from Human Papillomavirus
TSICKYPDYIK

SEQ ID NO: 40423 - protein, 9 aa, Artificial Sequence
  Peptide Derived from Human Papillomavirus
TSQAIACQK

SEQ ID NO: 40424 - protein, 10 aa, Artificial Sequence
  Peptide Derived from Human Papillomavirus
TSQAIACQKH

SEQ ID NO: 40425 - protein, 9 aa, Artificial Sequence
  Peptide Derived from Human Papillomavirus
TSRLLAVGH

SEQ ID NO: 40426 - protein, 11 aa, Artificial Sequence
  Peptide Derived from Human Papillomavirus
TSRLLAVGHPY

SEQ ID NO: 40427 - protein, 9 aa, Artificial Sequence
  Peptide Derived from Human Papillomavirus
TSSTSTTAK

SEQ ID NO: 40428 - protein, 10 aa, Artificial Sequence
  Peptide Derived from Human Papillomavirus
TSSTSTTAKR

SEQ ID NO: 40429 - protein, 11 aa, Artificial Sequence
  Peptide Derived from Human Papillomavirus
TSSTSTTAKRK

SEQ ID NO: 40430 - protein, 8 aa, Artificial Sequence
  Peptide Derived from Human Papillomavirus
TSTTAKRK

SEQ ID NO: 40431 - protein, 9 aa, Artificial Sequence
  Peptide Derived from Human Papillomavirus
TSTTAKRKK

SEQ ID NO: 40432 - protein, 10 aa, Artificial Sequence
  Peptide Derived from Human Papillomavirus
TSTTAKRKKR

SEQ ID NO: 40433 - protein, 11 aa, Artificial Sequence
  Peptide Derived from Human Papillomavirus
TSTTAKRKKRK

SEQ ID NO: 40434 - protein, 8 aa, Artificial Sequence
  Peptide Derived from Human Papillomavirus
TTAKRKKR

SEQ ID NO: 40435 - protein, 9 aa, Artificial Sequence
  Peptide Derived from Human Papillomavirus
TTAKRKKRK

SEQ ID NO: 40436 - protein, 10 aa, Artificial Sequence
  Peptide Derived from Human Papillomavirus
TTSSTSTTAK

SEQ ID NO: 40437 - protein, 11 aa, Artificial Sequence
  Peptide Derived from Human Papillomavirus
TTSSTSTTAKR

SEQ ID NO: 40438 - protein, 9 aa, Artificial Sequence
  Peptide Derived from Human Papillomavirus
TTYKNTNFK

SEQ ID NO: 40439 - protein, 11 aa, Artificial Sequence
  Peptide Derived from Human Papillomavirus
TTYKNTNFKEY

SEQ ID NO: 40440 - protein, 11 aa, Artificial Sequence
  Peptide Derived from Human Papillomavirus
TVYLPPVPVSK

SEQ ID NO: 40441 - protein, 8 aa, Artificial Sequence
  Peptide Derived from Human Papillomavirus
VARTNIYY

SEQ ID NO: 40442 - protein, 9 aa, Artificial Sequence
  Peptide Derived from Human Papillomavirus
VARTNIYYH

SEQ ID NO: 40443 - protein, 11 aa, Artificial Sequence
  Peptide Derived from Human Papillomavirus
VDNRECISMDY

SEQ ID NO: 40444 - protein, 11 aa, Artificial Sequence
  Peptide Derived from Human Papillomavirus
VFRIHLPDPNK

SEQ ID NO: 40445 - protein, 10 aa, Artificial Sequence
  Peptide Derived from Human Papillomavirus
VGENVPDDLY

SEQ ID NO: 40446 - protein, 9 aa, Artificial Sequence
  Peptide Derived from Human Papillomavirus
VGHPYFPIK

SEQ ID NO: 40447 - protein, 10 aa, Artificial Sequence
  Peptide Derived from Human Papillomavirus
VGHPYFPIKK

SEQ ID NO: 40448 - protein, 11 aa, Artificial Sequence
  Peptide Derived from Human Papillomavirus
VGISGHPLLNK

SEQ ID NO: 40449 - protein, 10 aa, Artificial Sequence
  Peptide Derived from Human Papillomavirus
VSGLQYRVFR

SEQ ID NO: 40450 - protein, 10 aa, Artificial Sequence
  Peptide Derived from Human Papillomavirus
VSKVVSTDEY

SEQ ID NO: 40451 - protein, 9 aa, Artificial Sequence
  Peptide Derived from Human Papillomavirus
VSTDEYVAR

SEQ ID NO: 40452 - protein, 10 aa, Artificial Sequence
  Peptide Derived from Human Papillomavirus
VTSDAQIFNK

SEQ ID NO: 40453 - protein, 10 aa, Artificial Sequence
  Peptide Derived from Human Papillomavirus
VTSQAIACQK

SEQ ID NO: 40454 - protein, 11 aa, Artificial Sequence
  Peptide Derived from Human Papillomavirus
VTSQAIACQKH

SEQ ID NO: 40455 - protein, 8 aa, Artificial Sequence
  Peptide Derived from Human Papillomavirus
VTVVDTTR

SEQ ID NO: 40456 - protein, 10 aa, Artificial Sequence
  Peptide Derived from Human Papillomavirus
VVSTDEYVAR

SEQ ID NO: 40457 - protein, 10 aa, Artificial Sequence
  Peptide Derived from Human Papillomavirus
WACVGVEVGR

SEQ ID NO: 40458 - protein, 9 aa, Artificial Sequence
  Peptide Derived from Human Papillomavirus
WLPSEATVY

SEQ ID NO: 40459 - protein, 8 aa, Artificial Sequence
  Peptide Derived from Human Papillomavirus
WLQRAQGH

SEQ ID NO: 40460 - protein, 10 aa, Artificial Sequence
  Peptide Derived from Human Papillomavirus
YAANAGVDNR

SEQ ID NO: 40461 - protein, 11 aa, Artificial Sequence
  Peptide Derived from Human Papillomavirus
YDLQFIFQLCK

SEQ ID NO: 40462 - protein, 11 aa, Artificial Sequence
  Peptide Derived from Human Papillomavirus
YFPIKKPNNNK

SEQ ID NO: 40463 - protein, 8 aa, Artificial Sequence
  Peptide Derived from Human Papillomavirus
YGDSLFFY

SEQ ID NO: 40464 - protein, 10 aa, Artificial Sequence
  Peptide Derived from Human Papillomavirus
YGDSLFFYLR

SEQ ID NO: 40465 - protein, 11 aa, Artificial Sequence
  Peptide Derived from Human Papillomavirus
YGDSLFFYLRR

SEQ ID NO: 40466 - protein, 9 aa, Artificial Sequence
  Peptide Derived from Human Papillomavirus
YIKMVSEPY

SEQ ID NO: 40467 - protein, 8 aa, Artificial Sequence
  Peptide Derived from Human Papillomavirus
YILVITCY

SEQ ID NO: 40468 - protein, 9 aa, Artificial Sequence
  Peptide Derived from Human Papillomavirus
YLPPVPVSK

SEQ ID NO: 40469 - protein, 8 aa, Artificial Sequence
  Peptide Derived from Human Papillomavirus
YLRHGEEY

SEQ ID NO: 40470 - protein, 10 aa, Artificial Sequence
  Peptide Derived from Human Papillomavirus
YLRREQMFVR

SEQ ID NO: 40471 - protein, 11 aa, Artificial Sequence
  Peptide Derived from Human Papillomavirus
YLRREQMFVRH

SEQ ID NO: 40472 - protein, 9 aa, Artificial Sequence
  Peptide Derived from Human Papillomavirus
YTFWEVNLK

SEQ ID NO: 40473 - protein, 11 aa, Artificial Sequence
  Peptide Derived from Human Papillomavirus
YTFWEVNLKEK

SEQ ID NO: 40474 - protein, 8 aa, Artificial Sequence
  Peptide Derived from Human Papillomavirus
YVARTNIY

SEQ ID NO: 40475 - protein, 9 aa, Artificial Sequence
  Peptide Derived from Human Papillomavirus
YVARTNIYY

SEQ ID NO: 40476 - protein, 10 aa, Artificial Sequence
  Peptide Derived from Human Papillomavirus
YVARTNIYYH

SEQ ID NO: 40477 - protein, 9 aa, Artificial Sequence
  Peptide Derived from Human Papillomavirus
ADAGDFYLH

SEQ ID NO: 40478 - protein, 8 aa, Artificial Sequence
  Peptide Derived from Human Papillomavirus
AFITTPTK

SEQ ID NO: 40479 - protein, 10 aa, Artificial Sequence
  Peptide Derived from Human Papillomavirus
AGDFYLHPSY

SEQ ID NO: 40480 - protein, 11 aa, Artificial Sequence
  Peptide Derived from Human Papillomavirus
AGDFYLHPSYY

SEQ ID NO: 40481 - protein, 11 aa, Artificial Sequence
  Peptide Derived from Human Papillomavirus
AGTCPPDIIPK

SEQ ID NO: 40482 - protein, 10 aa, Artificial Sequence
  Peptide Derived from Human Papillomavirus
ALHRPALTSR

SEQ ID NO: 40483 - protein, 11 aa, Artificial Sequence
  Peptide Derived from Human Papillomavirus
ALHRPALTSRR

SEQ ID NO: 40484 - protein, 11 aa, Artificial Sequence
  Peptide Derived from Human Papillomavirus
ALPTSINNGLY

SEQ ID NO: 40485 - protein, 10 aa, Artificial Sequence
  Peptide Derived from Human Papillomavirus
ALTSRRTGIR

SEQ ID NO: 40486 - protein, 11 aa, Artificial Sequence
  Peptide Derived from Human Papillomavirus
ALTSRRTGIRY

SEQ ID NO: 40487 - protein, 11 aa, Artificial Sequence
  Peptide Derived from Human Papillomavirus
ANTTIPFGGAY

SEQ ID NO: 40488 - protein, 8 aa, Artificial Sequence
  Peptide Derived from Human Papillomavirus
ASATQLYK

SEQ ID NO: 40489 - protein, 11 aa, Artificial Sequence
  Peptide Derived from Human Papillomavirus
ASATQLYKTCK

SEQ ID NO: 40490 - protein, 9 aa, Artificial Sequence
  Peptide Derived from Human Papillomavirus
ATDTLAPVR

SEQ ID NO: 40491 - protein, 9 aa, Artificial Sequence
  Peptide Derived from Human Papillomavirus
ATQLYKTCK

SEQ ID NO: 40492 - protein, 8 aa, Artificial Sequence
  Peptide Derived from Human Papillomavirus
DAGDFYLH

SEQ ID NO: 40493 - protein, 11 aa, Artificial Sequence
  Peptide Derived from Human Papillomavirus
DAGDFYLHPSY

SEQ ID NO: 40494 - protein, 9 aa, Artificial Sequence
  Peptide Derived from Human Papillomavirus
DFLDIVALH

SEQ ID NO: 40495 - protein, 10 aa, Artificial Sequence
  Peptide Derived from Human Papillomavirus
DFLDIVALHR

SEQ ID NO: 40496 - protein, 8 aa, Artificial Sequence
  Peptide Derived from Human Papillomavirus
DFYLHPSY

SEQ ID NO: 40497 - protein, 9 aa, Artificial Sequence
  Peptide Derived from Human Papillomavirus
DFYLHPSYY

SEQ ID NO: 40498 - protein, 9 aa, Artificial Sequence
  Peptide Derived from Human Papillomavirus
DIIPKVEGK

SEQ ID NO: 40499 - protein, 10 aa, Artificial Sequence
  Peptide Derived from Human Papillomavirus
EGIDVDNTLY

SEQ ID NO: 40500 - protein, 10 aa, Artificial Sequence
  Peptide Derived from Human Papillomavirus
ELQTITPSTY

SEQ ID NO: 40501 - protein, 11 aa, Artificial Sequence
  Peptide Derived from Human Papillomavirus
FITTPTKLITY

SEQ ID NO: 40502 - protein, 8 aa, Artificial Sequence
  Peptide Derived from Human Papillomavirus
FLDIVALH

SEQ ID NO: 40503 - protein, 9 aa, Artificial Sequence
  Peptide Derived from Human Papillomavirus
FLDIVALHR

SEQ ID NO: 40504 - protein, 11 aa, Artificial Sequence
  Peptide Derived from Human Papillomavirus
FTLSSSTISTH

SEQ ID NO: 40505 - protein, 8 aa, Artificial Sequence
  Peptide Derived from Human Papillomavirus
GAKVHYYY

SEQ ID NO: 40506 - protein, 9 aa, Artificial Sequence
  Peptide Derived from Human Papillomavirus
GDFYLHPSY

SEQ ID NO: 40507 - protein, 10 aa, Artificial Sequence
  Peptide Derived from Human Papillomavirus
GDFYLHPSYY

SEQ ID NO: 40508 - protein, 9 aa, Artificial Sequence
  Peptide Derived from Human Papillomavirus
GIDVDNTLY

SEQ ID NO: 40509 - protein, 11 aa, Artificial Sequence
  Peptide Derived from Human Papillomavirus
GIGTGSGTGGR

SEQ ID NO: 40510 - protein, 10 aa, Artificial Sequence
  Peptide Derived from Human Papillomavirus
GIRYSRIGNK

SEQ ID NO: 40511 - protein, 11 aa, Artificial Sequence
  Peptide Derived from Human Papillomavirus
GLYSRTTQQVK

SEQ ID NO: 40512 - protein, 9 aa, Artificial Sequence
  Peptide Derived from Human Papillomavirus
GNKQTLRTR

SEQ ID NO: 40513 - protein, 10 aa, Artificial Sequence
  Peptide Derived from Human Papillomavirus
GSGTGGRTGY

SEQ ID NO: 40514 - protein, 11 aa, Artificial Sequence
  Peptide Derived from Human Papillomavirus
GSRPVARLGLY

SEQ ID NO: 40515 - protein, 10 aa, Artificial Sequence
  Peptide Derived from Human Papillomavirus
GTCPPDIIPK

SEQ ID NO: 40516 - protein, 8 aa, Artificial Sequence
  Peptide Derived from Human Papillomavirus
GTGGRTGY

SEQ ID NO: 40517 - protein, 9 aa, Artificial Sequence
  Peptide Derived from Human Papillomavirus
GTGSGTGGR

SEQ ID NO: 40518 - protein, 8 aa, Artificial Sequence
  Peptide Derived from Human Papillomavirus
IADAGDFY

SEQ ID NO: 40519 - protein, 10 aa, Artificial Sequence
  Peptide Derived from Human Papillomavirus
IADAGDFYLH

SEQ ID NO: 40520 - protein, 8 aa, Artificial Sequence
  Peptide Derived from Human Papillomavirus
IADQILQY

SEQ ID NO: 40521 - protein, 8 aa, Artificial Sequence
  Peptide Derived from Human Papillomavirus
IDVDNTLY

SEQ ID NO: 40522 - protein, 8 aa, Artificial Sequence
  Peptide Derived from Human Papillomavirus
IGAKVHYY

SEQ ID NO: 40523 - protein, 9 aa, Artificial Sequence
  Peptide Derived from Human Papillomavirus
IGAKVHYYY

SEQ ID NO: 40524 - protein, 8 aa, Artificial Sequence
  Peptide Derived from Human Papillomavirus
IGNKQTLR

SEQ ID NO: 40525 - protein, 10 aa, Artificial Sequence
  Peptide Derived from Human Papillomavirus
IGNKQTLRTR

SEQ ID NO: 40526 - protein, 10 aa, Artificial Sequence
  Peptide Derived from Human Papillomavirus
IGTGSGTGGR

SEQ ID NO: 40527 - protein, 9 aa, Artificial Sequence
  Peptide Derived from Human Papillomavirus
IIADAGDFY

SEQ ID NO: 40528 - protein, 11 aa, Artificial Sequence
  Peptide Derived from Human Papillomavirus
IIADAGDFYLH

SEQ ID NO: 40529 - protein, 8 aa, Artificial Sequence
  Peptide Derived from Human Papillomavirus
IIPKVEGK

SEQ ID NO: 40530 - protein, 9 aa, Artificial Sequence
  Peptide Derived from Human Papillomavirus
INNGLYDIY

SEQ ID NO: 40531 - protein, 11 aa, Artificial Sequence
  Peptide Derived from Human Papillomavirus
INNTVTTVTTH

SEQ ID NO: 40532 - protein, 11 aa, Artificial Sequence
  Peptide Derived from Human Papillomavirus
ITPSTYTTTSH

SEQ ID NO: 40533 - protein, 10 aa, Artificial Sequence
  Peptide Derived from Human Papillomavirus
ITTPTKLITY

SEQ ID NO: 40534 - protein, 8 aa, Artificial Sequence
  Peptide Derived from Human Papillomavirus
ITYDNPAY

SEQ ID NO: 40535 - protein, 8 aa, Artificial Sequence
  Peptide Derived from Human Papillomavirus
IVPGSPQY

SEQ ID NO: 40536 - protein, 10 aa, Artificial Sequence
  Peptide Derived from Human Papillomavirus
KLITYDNPAY

SEQ ID NO: 40537 - protein, 8 aa, Artificial Sequence
  Peptide Derived from Human Papillomavirus
KSIGAKVH

SEQ ID NO: 40538 - protein, 9 aa, Artificial Sequence
  Peptide Derived from Human Papillomavirus
KSIGAKVHY

SEQ ID NO: 40539 - protein, 10 aa, Artificial Sequence
  Peptide Derived from Human Papillomavirus
KSIGAKVHYY

SEQ ID NO: 40540 - protein, 11 aa, Artificial Sequence
  Peptide Derived from Human Papillomavirus
KSIGAKVHYYY

SEQ ID NO: 40541 - protein, 10 aa, Artificial Sequence
  Peptide Derived from Human Papillomavirus
KTIADQILQY

SEQ ID NO: 40542 - protein, 8 aa, Artificial Sequence
  Peptide Derived from Human Papillomavirus
LDIVALHR

SEQ ID NO: 40543 - protein, 11 aa, Artificial Sequence
  Peptide Derived from Human Papillomavirus
LIPIVPGSPQY

SEQ ID NO: 40544 - protein, 9 aa, Artificial Sequence
  Peptide Derived from Human Papillomavirus
LITYDNPAY

SEQ ID NO: 40545 - protein, 9 aa, Artificial Sequence
  Peptide Derived from Human Papillomavirus
LSSSTISTH

SEQ ID NO: 40546 - protein, 11 aa, Artificial Sequence
  Peptide Derived from Human Papillomavirus
LSSSTISTHNY

SEQ ID NO: 40547 - protein, 9 aa, Artificial Sequence
  Peptide Derived from Human Papillomavirus
LTSRRTGIR

SEQ ID NO: 40548 - protein, 10 aa, Artificial Sequence
  Peptide Derived from Human Papillomavirus
LTSRRTGIRY

SEQ ID NO: 40549 - protein, 8 aa, Artificial Sequence
  Peptide Derived from Human Papillomavirus
MLRKRRKR

SEQ ID NO: 40550 - protein, 11 aa, Artificial Sequence
  Peptide Derived from Human Papillomavirus
MLRKRRKRLPY

SEQ ID NO: 40551 - protein, 8 aa, Artificial Sequence
  Peptide Derived from Human Papillomavirus
NNGLYDIY

SEQ ID NO: 40552 - protein, 10 aa, Artificial Sequence
  Peptide Derived from Human Papillomavirus
NNTVTTVTTH

SEQ ID NO: 40553 - protein, 10 aa, Artificial Sequence
  Peptide Derived from Human Papillomavirus
NTTIPFGGAY

SEQ ID NO: 40554 - protein, 9 aa, Artificial Sequence
  Peptide Derived from Human Papillomavirus
NTVTTVTTH

SEQ ID NO: 40555 - protein, 9 aa, Artificial Sequence
  Peptide Derived from Human Papillomavirus
PAFITTPTK

SEQ ID NO: 40556 - protein, 11 aa, Artificial Sequence
  Peptide Derived from Human Papillomavirus
PALTSRRTGIR

SEQ ID NO: 40557 - protein, 10 aa, Artificial Sequence
  Peptide Derived from Human Papillomavirus
PDFLDIVALH

SEQ ID NO: 40558 - protein, 11 aa, Artificial Sequence
  Peptide Derived from Human Papillomavirus
PDFLDIVALHR

SEQ ID NO: 40559 - protein, 10 aa, Artificial Sequence
  Peptide Derived from Human Papillomavirus
PDIIPKVEGK

SEQ ID NO: 40560 - protein, 8 aa, Artificial Sequence
  Peptide Derived from Human Papillomavirus
PGSRPVAR

SEQ ID NO: 40561 - protein, 10 aa, Artificial Sequence
  Peptide Derived from Human Papillomavirus
PIPGSRPVAR

SEQ ID NO: 40562 - protein, 9 aa, Artificial Sequence
  Peptide Derived from Human Papillomavirus
PIVPGSPQY

SEQ ID NO: 40563 - protein, 8 aa, Artificial Sequence
  Peptide Derived from Human Papillomavirus
PSTSLSGY

SEQ ID NO: 40564 - protein, 9 aa, Artificial Sequence
  Peptide Derived from Human Papillomavirus
PSTYTTTSH

SEQ ID NO: 40565 - protein, 11 aa, Artificial Sequence
  Peptide Derived from Human Papillomavirus
PSVPSTSLSGY

SEQ ID NO: 40566 - protein, 8 aa, Artificial Sequence
  Peptide Derived from Human Papillomavirus
PSYYMLRK

SEQ ID NO: 40567 - protein, 9 aa, Artificial Sequence
  Peptide Derived from Human Papillomavirus
PSYYMLRKR

SEQ ID NO: 40568 - protein, 10 aa, Artificial Sequence
  Peptide Derived from Human Papillomavirus
PSYYMLRKRR

SEQ ID NO: 40569 - protein, 11 aa, Artificial Sequence
  Peptide Derived from Human Papillomavirus
PSYYMLRKRRK

SEQ ID NO: 40570 - protein, 11 aa, Artificial Sequence
  Peptide Derived from Human Papillomavirus
PTATDTLAPVR

SEQ ID NO: 40571 - protein, 9 aa, Artificial Sequence
  Peptide Derived from Human Papillomavirus
PTPAETGGH

SEQ ID NO: 40572 - protein, 9 aa, Artificial Sequence
  Peptide Derived from Human Papillomavirus
PTSINNGLY

SEQ ID NO: 40573 - protein, 8 aa, Artificial Sequence
  Peptide Derived from Human Papillomavirus
PVARLGLY

SEQ ID NO: 40574 - protein, 10 aa, Artificial Sequence
  Peptide Derived from Human Papillomavirus
PVARLGLYSR

SEQ ID NO: 40575 - protein, 8 aa, Artificial Sequence
  Peptide Derived from Human Papillomavirus
QTITPSTY

SEQ ID NO: 40576 - protein, 9 aa, Artificial Sequence
  Peptide Derived from Human Papillomavirus
QTLRTRSGK

SEQ ID NO: 40577 - protein, 8 aa, Artificial Sequence
  Peptide Derived from Human Papillomavirus
RASATQLY

SEQ ID NO: 40578 - protein, 9 aa, Artificial Sequence
  Peptide Derived from Human Papillomavirus
RASATQLYK

SEQ ID NO: 40579 - protein, 9 aa, Artificial Sequence
  Peptide Derived from Human Papillomavirus
RIGNKQTLR

SEQ ID NO: 40580 - protein, 11 aa, Artificial Sequence
  Peptide Derived from Human Papillomavirus
RIGNKQTLRTR

SEQ ID NO: 40581 - protein, 8 aa, Artificial Sequence
  Peptide Derived from Human Papillomavirus
RSAKRTKR

SEQ ID NO: 40582 - protein, 9 aa, Artificial Sequence
  Peptide Derived from Human Papillomavirus
RSGKSIGAK

SEQ ID NO: 40583 - protein, 11 aa, Artificial Sequence
  Peptide Derived from Human Papillomavirus
RSGKSIGAKVH

SEQ ID NO: 40584 - protein, 8 aa, Artificial Sequence
  Peptide Derived from Human Papillomavirus
RTGIRYSR

SEQ ID NO: 40585 - protein, 10 aa, Artificial Sequence
  Peptide Derived from Human Papillomavirus
RTGYIPLGTR

SEQ ID NO: 40586 - protein, 11 aa, Artificial Sequence
  Peptide Derived from Human Papillomavirus
RTKRASATQLY

SEQ ID NO: 40587 - protein, 11 aa, Artificial Sequence
  Peptide Derived from Human Papillomavirus
RTRSGKSIGAK

SEQ ID NO: 40588 - protein, 10 aa, Artificial Sequence
  Peptide Derived from Human Papillomavirus
SATQLYKTCK

SEQ ID NO: 40589 - protein, 8 aa, Artificial Sequence
  Peptide Derived from Human Papillomavirus
SGKSIGAK

SEQ ID NO: 40590 - protein, 10 aa, Artificial Sequence
  Peptide Derived from Human Papillomavirus
SGKSIGAKVH

SEQ ID NO: 40591 - protein, 11 aa, Artificial Sequence
  Peptide Derived from Human Papillomavirus
SGKSIGAKVHY

SEQ ID NO: 40592 - protein, 9 aa, Artificial Sequence
  Peptide Derived from Human Papillomavirus
SGTGGRTGY

SEQ ID NO: 40593 - protein, 8 aa, Artificial Sequence
  Peptide Derived from Human Papillomavirus
SIGAKVHY

SEQ ID NO: 40594 - protein, 9 aa, Artificial Sequence
  Peptide Derived from Human Papillomavirus
SIGAKVHYY

SEQ ID NO: 40595 - protein, 10 aa, Artificial Sequence
  Peptide Derived from Human Papillomavirus
SIGAKVHYYY

SEQ ID NO: 40596 - protein, 10 aa, Artificial Sequence
  Peptide Derived from Human Papillomavirus
SINNGLYDIY

SEQ ID NO: 40597 - protein, 8 aa, Artificial Sequence
  Peptide Derived from Human Papillomavirus
SSSTISTH

SEQ ID NO: 40598 - protein, 10 aa, Artificial Sequence
  Peptide Derived from Human Papillomavirus
SSSTISTHNY

SEQ ID NO: 40599 - protein, 9 aa, Artificial Sequence
  Peptide Derived from Human Papillomavirus
SSTISTHNY

SEQ ID NO: 40600 - protein, 9 aa, Artificial Sequence
  Peptide Derived from Human Papillomavirus
SSTPIPGSR

SEQ ID NO: 40601 - protein, 8 aa, Artificial Sequence
  Peptide Derived from Human Papillomavirus
STISTHNY

SEQ ID NO: 40602 - protein, 8 aa, Artificial Sequence
  Peptide Derived from Human Papillomavirus
STPIPGSR

SEQ ID NO: 40603 - protein, 8 aa, Artificial Sequence
  Peptide Derived from Human Papillomavirus
STYTTTSH

SEQ ID NO: 40604 - protein, 10 aa, Artificial Sequence
  Peptide Derived from Human Papillomavirus
SVPSTSLSGY

SEQ ID NO: 40605 - protein, 10 aa, Artificial Sequence
  Peptide Derived from Human Papillomavirus
TATDTLAPVR

SEQ ID NO: 40606 - protein, 9 aa, Artificial Sequence
  Peptide Derived from Human Papillomavirus
TCPPDIIPK

SEQ ID NO: 40607 - protein, 8 aa, Artificial Sequence
  Peptide Derived from Human Papillomavirus
TDTLAPVR

SEQ ID NO: 40608 - protein, 11 aa, Artificial Sequence
  Peptide Derived from Human Papillomavirus
TGIRYSRIGNK

SEQ ID NO: 40609 - protein, 8 aa, Artificial Sequence
  Peptide Derived from Human Papillomavirus
TGSGTGGR

SEQ ID NO: 40610 - protein, 11 aa, Artificial Sequence
  Peptide Derived from Human Papillomavirus
TGSGTGGRTGY

SEQ ID NO: 40611 - protein, 9 aa, Artificial Sequence
  Peptide Derived from Human Papillomavirus
TGYIPLGTR

SEQ ID NO: 40612 - protein, 9 aa, Artificial Sequence
  Peptide Derived from Human Papillomavirus
TIADQILQY

SEQ ID NO: 40613 - protein, 10 aa, Artificial Sequence
  Peptide Derived from Human Papillomavirus
TIIADAGDFY

SEQ ID NO: 40614 - protein, 8 aa, Artificial Sequence
  Peptide Derived from Human Papillomavirus
TIPFGGAY

SEQ ID NO: 40615 - protein, 8 aa, Artificial Sequence
  Peptide Derived from Human Papillomavirus
TLRTRSGK

SEQ ID NO: 40616 - protein, 10 aa, Artificial Sequence
  Peptide Derived from Human Papillomavirus
TLSSSTISTH

SEQ ID NO: 40617 - protein, 8 aa, Artificial Sequence
  Peptide Derived from Human Papillomavirus
TSINNGLY

SEQ ID NO: 40618 - protein, 11 aa, Artificial Sequence
  Peptide Derived from Human Papillomavirus
TSINNGLYDIY

SEQ ID NO: 40619 - protein, 8 aa, Artificial Sequence
  Peptide Derived from Human Papillomavirus
TSRRTGIR

SEQ ID NO: 40620 - protein, 9 aa, Artificial Sequence
  Peptide Derived from Human Papillomavirus
TSRRTGIRY

SEQ ID NO: 40621 - protein, 11 aa, Artificial Sequence
  Peptide Derived from Human Papillomavirus
TSRRTGIRYSR

SEQ ID NO: 40622 - protein, 10 aa, Artificial Sequence
  Peptide Derived from Human Papillomavirus
TSSTPIPGSR

SEQ ID NO: 40623 - protein, 9 aa, Artificial Sequence
  Peptide Derived from Human Papillomavirus
TTIPFGGAY

SEQ ID NO: 40624 - protein, 9 aa, Artificial Sequence
  Peptide Derived from Human Papillomavirus
TTPTKLITY

SEQ ID NO: 40625 - protein, 8 aa, Artificial Sequence
  Peptide Derived from Human Papillomavirus
TVTTVTTH

SEQ ID NO: 40626 - protein, 11 aa, Artificial Sequence
  Peptide Derived from Human Papillomavirus
VALHRPALTSR

SEQ ID NO: 40627 - protein, 9 aa, Artificial Sequence
  Peptide Derived from Human Papillomavirus
VARLGLYSR

SEQ ID NO: 40628 - protein, 11 aa, Artificial Sequence
  Peptide Derived from Human Papillomavirus
VDPAFITTPTK

SEQ ID NO: 40629 - protein, 11 aa, Artificial Sequence
  Peptide Derived from Human Papillomavirus
VTSSTPIPGSR

SEQ ID NO: 40630 - protein, 10 aa, Artificial Sequence
  Peptide Derived from Human Papillomavirus
YLHPSYYMLR

SEQ ID NO: 40631 - protein, 11 aa, Artificial Sequence
  Peptide Derived from Human Papillomavirus
YLHPSYYMLRK

SEQ ID NO: 40632 - protein, 8 aa, Artificial Sequence
  Peptide Derived from Human Papillomavirus
YMLRKRRK

SEQ ID NO: 40633 - protein, 9 aa, Artificial Sequence
  Peptide Derived from Human Papillomavirus
YMLRKRRKR

SEQ ID NO: 40634 - protein, 11 aa, Artificial Sequence
  Peptide Derived from Human Papillomavirus
YSRIGNKQTLR

SEQ ID NO: 40635 - protein, 9 aa, Artificial Sequence
  Peptide Derived from Human Papillomavirus
YSRTTQQVK

SEQ ID NO: 40636 - protein, 11 aa, Artificial Sequence
  Peptide Derived from Human Papillomavirus
YTIIADAGDFY

SEQ ID NO: 40637 - protein, 11 aa, Artificial Sequence
  Peptide Derived from Human Papillomavirus
AAFLKSNCQAK

SEQ ID NO: 40638 - protein, 10 aa, Artificial Sequence
  Peptide Derived from Human Papillomavirus
AFLKSNCQAK

SEQ ID NO: 40639 - protein, 11 aa, Artificial Sequence
  Peptide Derived from Human Papillomavirus
AFLKSNCQAKY

SEQ ID NO: 40640 - protein, 11 aa, Artificial Sequence
  Peptide Derived from Human Papillomavirus
ALDGNPISIDR

SEQ ID NO: 40641 - protein, 9 aa, Artificial Sequence
  Peptide Derived from Human Papillomavirus
ALFHAQEVH

SEQ ID NO: 40642 - protein, 11 aa, Artificial Sequence
  Peptide Derived from Human Papillomavirus
ALKSFLKGTPK

SEQ ID NO: 40643 - protein, 9 aa, Artificial Sequence
  Peptide Derived from Human Papillomavirus
ALLRYKCGK

SEQ ID NO: 40644 - protein, 11 aa, Artificial Sequence
  Peptide Derived from Human Papillomavirus
ALLRYKCGKSR

SEQ ID NO: 40645 - protein, 10 aa, Artificial Sequence
  Peptide Derived from Human Papillomavirus
AMLAVFKDTY

SEQ ID NO: 40646 - protein, 8 aa, Artificial Sequence
  Peptide Derived from Human Papillomavirus
ATMCKHYR

SEQ ID NO: 40647 - protein, 9 aa, Artificial Sequence
  Peptide Derived from Human Papillomavirus
ATMCKHYRR

SEQ ID NO: 40648 - protein, 8 aa, Artificial Sequence
  Peptide Derived from Human Papillomavirus
ATTTCWTY

SEQ ID NO: 40649 - protein, 11 aa, Artificial Sequence
  Peptide Derived from Human Papillomavirus
AVISFVNSTSH

SEQ ID NO: 40650 - protein, 8 aa, Artificial Sequence
  Peptide Derived from Human Papillomavirus
CATMCKHY

SEQ ID NO: 40651 - protein, 9 aa, Artificial Sequence
  Peptide Derived from Human Papillomavirus
CATMCKHYR

SEQ ID NO: 40652 - protein, 10 aa, Artificial Sequence
  Peptide Derived from Human Papillomavirus
CATMCKHYRR

SEQ ID NO: 40653 - protein, 9 aa, Artificial Sequence
  Peptide Derived from Human Papillomavirus
CFFERTWSR

SEQ ID NO: 40654 - protein, 10 aa, Artificial Sequence
  Peptide Derived from Human Papillomavirus
CGKSRLTVAK

SEQ ID NO: 40655 - protein, 8 aa, Artificial Sequence
  Peptide Derived from Human Papillomavirus
CGPANTGK

SEQ ID NO: 40656 - protein, 10 aa, Artificial Sequence
  Peptide Derived from Human Papillomavirus
CGPANTGKSY

SEQ ID NO: 40657 - protein, 8 aa, Artificial Sequence
  Peptide Derived from Human Papillomavirus
CMLIQPPK

SEQ ID NO: 40658 - protein, 10 aa, Artificial Sequence
  Peptide Derived from Human Papillomavirus
CMLIQPPKLR

SEQ ID NO: 40659 - protein, 11 aa, Artificial Sequence
  Peptide Derived from Human Papillomavirus
CSKIDEGGDWR

SEQ ID NO: 40660 - protein, 11 aa, Artificial Sequence
  Peptide Derived from Human Papillomavirus
CTIAQLKDLLK

SEQ ID NO: 40661 - protein, 9 aa, Artificial Sequence
  Peptide Derived from Human Papillomavirus
DAQVLHVLK

SEQ ID NO: 40662 - protein, 10 aa, Artificial Sequence
  Peptide Derived from Human Papillomavirus
DAQVLHVLKR

SEQ ID NO: 40663 - protein, 11 aa, Artificial Sequence
  Peptide Derived from Human Papillomavirus
DAQVLHVLKRK

SEQ ID NO: 40664 - protein, 9 aa, Artificial Sequence
  Peptide Derived from Human Papillomavirus
DATTTCWTY

SEQ ID NO: 40665 - protein, 8 aa, Artificial Sequence
  Peptide Derived from Human Papillomavirus
DCATMCKH

SEQ ID NO: 40666 - protein, 9 aa, Artificial Sequence
  Peptide Derived from Human Papillomavirus
DCATMCKHY

SEQ ID NO: 40667 - protein, 10 aa, Artificial Sequence
  Peptide Derived from Human Papillomavirus
DCATMCKHYR

SEQ ID NO: 40668 - protein, 11 aa, Artificial Sequence
  Peptide Derived from Human Papillomavirus
DCATMCKHYRR

SEQ ID NO: 40669 - protein, 10 aa, Artificial Sequence
  Peptide Derived from Human Papillomavirus
DDATTTCWTY

SEQ ID NO: 40670 - protein, 9 aa, Artificial Sequence
  Peptide Derived from Human Papillomavirus
DGNPISIDR

SEQ ID NO: 40671 - protein, 10 aa, Artificial Sequence
  Peptide Derived from Human Papillomavirus
DGNPISIDRK

SEQ ID NO: 40672 - protein, 11 aa, Artificial Sequence
  Peptide Derived from Human Papillomavirus
DGNPISIDRKH

SEQ ID NO: 40673 - protein, 8 aa, Artificial Sequence
  Peptide Derived from Human Papillomavirus
DLLKVNNK

SEQ ID NO: 40674 - protein, 10 aa, Artificial Sequence
  Peptide Derived from Human Papillomavirus
DLVRNFKSDK

SEQ ID NO: 40675 - protein, 10 aa, Artificial Sequence
  Peptide Derived from Human Papillomavirus
DNRWPYLESR

SEQ ID NO: 40676 - protein, 11 aa, Artificial Sequence
  Peptide Derived from Human Papillomavirus
DSNSNAAAFLK

SEQ ID NO: 40677 - protein, 11 aa, Artificial Sequence
  Peptide Derived from Human Papillomavirus
DTEGNPFGTFK

SEQ ID NO: 40678 - protein, 8 aa, Artificial Sequence
  Peptide Derived from Human Papillomavirus
DTPEWIQR

SEQ ID NO: 40679 - protein, 10 aa, Artificial Sequence
  Peptide Derived from Human Papillomavirus
EFITFLGALK

SEQ ID NO: 40680 - protein, 10 aa, Artificial Sequence
  Peptide Derived from Human Papillomavirus
EFPNAFPFDK

SEQ ID NO: 40681 - protein, 9 aa, Artificial Sequence
  Peptide Derived from Human Papillomavirus
EGNPFGTFK

SEQ ID NO: 40682 - protein, 11 aa, Artificial Sequence
  Peptide Derived from Human Papillomavirus
EGNPFGTFKLR

SEQ ID NO: 40683 - protein, 10 aa, Artificial Sequence
  Peptide Derived from Human Papillomavirus
EGTGCNGWFY

SEQ ID NO: 40684 - protein, 8 aa, Artificial Sequence
  Peptide Derived from Human Papillomavirus
EINDKNWK

SEQ ID NO: 40685 - protein, 9 aa, Artificial Sequence
  Peptide Derived from Human Papillomavirus
EISLNSGQK

SEQ ID NO: 40686 - protein, 10 aa, Artificial Sequence
  Peptide Derived from Human Papillomavirus
EISLNSGQKK

SEQ ID NO: 40687 - protein, 10 aa, Artificial Sequence
  Peptide Derived from Human Papillomavirus
ELETAQALFH

SEQ ID NO: 40688 - protein, 8 aa, Artificial Sequence
  Peptide Derived from Human Papillomavirus
ENSPLGER

SEQ ID NO: 40689 - protein, 8 aa, Artificial Sequence
  Peptide Derived from Human Papillomavirus
ESDMAFEY

SEQ ID NO: 40690 - protein, 8 aa, Artificial Sequence
  Peptide Derived from Human Papillomavirus
ETAQALFH

SEQ ID NO: 40691 - protein, 10 aa, Artificial Sequence
  Peptide Derived from Human Papillomavirus
ETCMLIQPPK

SEQ ID NO: 40692 - protein, 9 aa, Artificial Sequence
  Peptide Derived from Human Papillomavirus
EVDTELSPR

SEQ ID NO: 40693 - protein, 10 aa, Artificial Sequence
  Peptide Derived from Human Papillomavirus
EVHNDAQVLH

SEQ ID NO: 40694 - protein, 9 aa, Artificial Sequence
  Peptide Derived from Human Papillomavirus
FCGPANTGK

SEQ ID NO: 40695 - protein, 11 aa, Artificial Sequence
  Peptide Derived from Human Papillomavirus
FCGPANTGKSY

SEQ ID NO: 40696 - protein, 9 aa, Artificial Sequence
  Peptide Derived from Human Papillomavirus
FDKNGNPVY

SEQ ID NO: 40697 - protein, 8 aa, Artificial Sequence
  Peptide Derived from Human Papillomavirus
FFERTWSR

SEQ ID NO: 40698 - protein, 9 aa, Artificial Sequence
  Peptide Derived from Human Papillomavirus
FITFLGALK

SEQ ID NO: 40699 - protein, 10 aa, Artificial Sequence
  Peptide Derived from Human Papillomavirus
FLGALKSFLK

SEQ ID NO: 40700 - protein, 8 aa, Artificial Sequence
  Peptide Derived from Human Papillomavirus
FLKGTPKK

SEQ ID NO: 40701 - protein, 9 aa, Artificial Sequence
  Peptide Derived from Human Papillomavirus
FLKSNCQAK

SEQ ID NO: 40702 - protein, 10 aa, Artificial Sequence
  Peptide Derived from Human Papillomavirus
FLKSNCQAKY

SEQ ID NO: 40703 - protein, 9 aa, Artificial Sequence
  Peptide Derived from Human Papillomavirus
FTDLVRNFK

SEQ ID NO: 40704 - protein, 8 aa, Artificial Sequence
  Peptide Derived from Human Papillomavirus
FTISDSGY

SEQ ID NO: 40705 - protein, 8 aa, Artificial Sequence
  Peptide Derived from Human Papillomavirus
GALKSFLK

SEQ ID NO: 40706 - protein, 8 aa, Artificial Sequence
  Peptide Derived from Human Papillomavirus
GAMLAVFK

SEQ ID NO: 40707 - protein, 11 aa, Artificial Sequence
  Peptide Derived from Human Papillomavirus
GAMLAVFKDTY

SEQ ID NO: 40708 - protein, 9 aa, Artificial Sequence
  Peptide Derived from Human Papillomavirus
GDTPEWIQR

SEQ ID NO: 40709 - protein, 11 aa, Artificial Sequence
  Peptide Derived from Human Papillomavirus
GDWRPIVQFLR

SEQ ID NO: 40710 - protein, 9 aa, Artificial Sequence
  Peptide Derived from Human Papillomavirus
GLSFTDLVR

SEQ ID NO: 40711 - protein, 8 aa, Artificial Sequence
  Peptide Derived from Human Papillomavirus
GNPFGTFK

SEQ ID NO: 40712 - protein, 10 aa, Artificial Sequence
  Peptide Derived from Human Papillomavirus
GNPFGTFKLR

SEQ ID NO: 40713 - protein, 8 aa, Artificial Sequence
  Peptide Derived from Human Papillomavirus
GNPISIDR

SEQ ID NO: 40714 - protein, 9 aa, Artificial Sequence
  Peptide Derived from Human Papillomavirus
GNPISIDRK

SEQ ID NO: 40715 - protein, 10 aa, Artificial Sequence
  Peptide Derived from Human Papillomavirus
GNPISIDRKH

SEQ ID NO: 40716 - protein, 11 aa, Artificial Sequence
  Peptide Derived from Human Papillomavirus
GNPISIDRKHK

SEQ ID NO: 40717 - protein, 10 aa, Artificial Sequence
  Peptide Derived from Human Papillomavirus
GNPVYEINDK

SEQ ID NO: 40718 - protein, 11 aa, Artificial Sequence
  Peptide Derived from Human Papillomavirus
GSTENSPLGER

SEQ ID NO: 40719 - protein, 11 aa, Artificial Sequence
  Peptide Derived from Human Papillomavirus
GTFKLRAGQNH

SEQ ID NO: 40720 - protein, 9 aa, Artificial Sequence
  Peptide Derived from Human Papillomavirus
GTGCNGWFY

SEQ ID NO: 40721 - protein, 9 aa, Artificial Sequence
  Peptide Derived from Human Papillomavirus
GVLILALLR

SEQ ID NO: 40722 - protein, 10 aa, Artificial Sequence
  Peptide Derived from Human Papillomavirus
GVLILALLRY

SEQ ID NO: 40723 - protein, 11 aa, Artificial Sequence
  Peptide Derived from Human Papillomavirus
GVLILALLRYK

SEQ ID NO: 40724 - protein, 11 aa, Artificial Sequence
  Peptide Derived from Human Papillomavirus
GVNPTIAEGFK

SEQ ID NO: 40725 - protein, 11 aa, Artificial Sequence
  Peptide Derived from Human Papillomavirus
HFWLEPLTDTK

SEQ ID NO: 40726 - protein, 8 aa, Artificial Sequence
  Peptide Derived from Human Papillomavirus
HIQCLDCK

SEQ ID NO: 40727 - protein, 8 aa, Artificial Sequence
  Peptide Derived from Human Papillomavirus
HNDAQVLH

SEQ ID NO: 40728 - protein, 11 aa, Artificial Sequence
  Peptide Derived from Human Papillomavirus
HNDAQVLHVLK

SEQ ID NO: 40729 - protein, 9 aa, Artificial Sequence
  Peptide Derived from Human Papillomavirus
IAQLKDLLK

SEQ ID NO: 40730 - protein, 8 aa, Artificial Sequence
  Peptide Derived from Human Papillomavirus
IDEGGDWR

SEQ ID NO: 40731 - protein, 8 aa, Artificial Sequence
  Peptide Derived from Human Papillomavirus
ILALLRYK

SEQ ID NO: 40732 - protein, 11 aa, Artificial Sequence
  Peptide Derived from Human Papillomavirus
ILALLRYKCGK

SEQ ID NO: 40733 - protein, 8 aa, Artificial Sequence
  Peptide Derived from Human Papillomavirus
ILLTTNIH

SEQ ID NO: 40734 - protein, 11 aa, Artificial Sequence
  Peptide Derived from Human Papillomavirus
ILLTTNIHPAK

SEQ ID NO: 40735 - protein, 9 aa, Artificial Sequence
  Peptide Derived from Human Papillomavirus
ISFVNSTSH

SEQ ID NO: 40736 - protein, 8 aa, Artificial Sequence
  Peptide Derived from Human Papillomavirus
ISIDRKHK

SEQ ID NO: 40737 - protein, 8 aa, Artificial Sequence
  Peptide Derived from Human Papillomavirus
ISLNSGQK

SEQ ID NO: 40738 - protein, 9 aa, Artificial Sequence
  Peptide Derived from Human Papillomavirus
ISLNSGQKK

SEQ ID NO: 40739 - protein, 11 aa, Artificial Sequence
  Peptide Derived from Human Papillomavirus
ISLNSGQKKAK

SEQ ID NO: 40740 - protein, 8 aa, Artificial Sequence
  Peptide Derived from Human Papillomavirus
ITFLGALK

SEQ ID NO: 40741 - protein, 10 aa, Artificial Sequence
  Peptide Derived from Human Papillomavirus
KCFFERTWSR

SEQ ID NO: 40742 - protein, 11 aa, Artificial Sequence
  Peptide Derived from Human Papillomavirus
KCGKSRLTVAK

SEQ ID NO: 40743 - protein, 8 aa, Artificial Sequence
  Peptide Derived from Human Papillomavirus
KDCATMCK

SEQ ID NO: 40744 - protein, 9 aa, Artificial Sequence
  Peptide Derived from Human Papillomavirus
KDCATMCKH

SEQ ID NO: 40745 - protein, 10 aa, Artificial Sequence
  Peptide Derived from Human Papillomavirus
KDCATMCKHY

SEQ ID NO: 40746 - protein, 11 aa, Artificial Sequence
  Peptide Derived from Human Papillomavirus
KDCATMCKHYR

SEQ ID NO: 40747 - protein, 9 aa, Artificial Sequence
  Peptide Derived from Human Papillomavirus
KDLLKVNNK

SEQ ID NO: 40748 - protein, 11 aa, Artificial Sequence
  Peptide Derived from Human Papillomavirus
KDNRWPYLESR

SEQ ID NO: 40749 - protein, 8 aa, Artificial Sequence
  Peptide Derived from Human Papillomavirus
KGLSTLLH

SEQ ID NO: 40750 - protein, 9 aa, Artificial Sequence
  Peptide Derived from Human Papillomavirus
KIDEGGDWR

SEQ ID NO: 40751 - protein, 8 aa, Artificial Sequence
  Peptide Derived from Human Papillomavirus
KLRAGQNH

SEQ ID NO: 40752 - protein, 9 aa, Artificial Sequence
  Peptide Derived from Human Papillomavirus
KLRAGQNHR

SEQ ID NO: 40753 - protein, 10 aa, Artificial Sequence
  Peptide Derived from Human Papillomavirus
KLRSSVAALY

SEQ ID NO: 40754 - protein, 9 aa, Artificial Sequence
  Peptide Derived from Human Papillomavirus
KNWKCFFER

SEQ ID NO: 40755 - protein, 9 aa, Artificial Sequence
  Peptide Derived from Human Papillomavirus
KSFLKGTPK

SEQ ID NO: 40756 - protein, 10 aa, Artificial Sequence
  Peptide Derived from Human Papillomavirus
KSFLKGTPKK

SEQ ID NO: 40757 - protein, 8 aa, Artificial Sequence
  Peptide Derived from Human Papillomavirus
KSNCQAKY

SEQ ID NO: 40758 - protein, 10 aa, Artificial Sequence
  Peptide Derived from Human Papillomavirus
KSNCQAKYLK

SEQ ID NO: 40759 - protein, 8 aa, Artificial Sequence
  Peptide Derived from Human Papillomavirus
KSRLTVAK

SEQ ID NO: 40760 - protein, 10 aa, Artificial Sequence
  Peptide Derived from Human Papillomavirus
KSYFGMSFIH

SEQ ID NO: 40761 - protein, 10 aa, Artificial Sequence
  Peptide Derived from Human Papillomavirus
KTLIQPFILY

SEQ ID NO: 40762 - protein, 10 aa, Artificial Sequence
  Peptide Derived from Human Papillomavirus
LALLRYKCGK

SEQ ID NO: 40763 - protein, 8 aa, Artificial Sequence
  Peptide Derived from Human Papillomavirus
LAVFKDTY

SEQ ID NO: 40764 - protein, 11 aa, Artificial Sequence
  Peptide Derived from Human Papillomavirus
LDDATTTCWTY

SEQ ID NO: 40765 - protein, 10 aa, Artificial Sequence
  Peptide Derived from Human Papillomavirus
LDGNPISIDR

SEQ ID NO: 40766 - protein, 11 aa, Artificial Sequence
  Peptide Derived from Human Papillomavirus
LDGNPISIDRK

SEQ ID NO: 40767 - protein, 8 aa, Artificial Sequence
  Peptide Derived from Human Papillomavirus
LFHAQEVH

SEQ ID NO: 40768 - protein, 9 aa, Artificial Sequence
  Peptide Derived from Human Papillomavirus
LFTISDSGY

SEQ ID NO: 40769 - protein, 9 aa, Artificial Sequence
  Peptide Derived from Human Papillomavirus
LGALKSFLK

SEQ ID NO: 40770 - protein, 8 aa, Artificial Sequence
  Peptide Derived from Human Papillomavirus
LILALLRY

SEQ ID NO: 40771 - protein, 9 aa, Artificial Sequence
  Peptide Derived from Human Papillomavirus
LILALLRYK

SEQ ID NO: 40772 - protein, 8 aa, Artificial Sequence
  Peptide Derived from Human Papillomavirus
LIQPFILY

SEQ ID NO: 40773 - protein, 10 aa, Artificial Sequence
  Peptide Derived from Human Papillomavirus
LIQPFILYAH

SEQ ID NO: 40774 - protein, 8 aa, Artificial Sequence
  Peptide Derived from Human Papillomavirus
LIQPPKLR

SEQ ID NO: 40775 - protein, 8 aa, Artificial Sequence
  Peptide Derived from Human Papillomavirus
LLRYKCGK

SEQ ID NO: 40776 - protein, 10 aa, Artificial Sequence
  Peptide Derived from Human Papillomavirus
LLRYKCGKSR

SEQ ID NO: 40777 - protein, 10 aa, Artificial Sequence
  Peptide Derived from Human Papillomavirus
LLTTNIHPAK

SEQ ID NO: 40778 - protein, 9 aa, Artificial Sequence
  Peptide Derived from Human Papillomavirus
LNSGQKKAK

SEQ ID NO: 40779 - protein, 10 aa, Artificial Sequence
  Peptide Derived from Human Papillomavirus
LNSGQKKAKR

SEQ ID NO: 40780 - protein, 11 aa, Artificial Sequence
  Peptide Derived from Human Papillomavirus
LNSGQKKAKRR

SEQ ID NO: 40781 - protein, 8 aa, Artificial Sequence
  Peptide Derived from Human Papillomavirus
LSFTDLVR

SEQ ID NO: 40782 - protein, 11 aa, Artificial Sequence
  Peptide Derived from Human Papillomavirus
LSFTDLVRNFK

SEQ ID NO: 40783 - protein, 11 aa, Artificial Sequence
  Peptide Derived from Human Papillomavirus
LTDESDMAFEY

SEQ ID NO: 40784 - protein, 9 aa, Artificial Sequence
  Peptide Derived from Human Papillomavirus
LTTNIHPAK

SEQ ID NO: 40785 - protein, 11 aa, Artificial Sequence
  Peptide Derived from Human Papillomavirus
LVFCGPANTGK

SEQ ID NO: 40786 - protein, 9 aa, Artificial Sequence
  Peptide Derived from Human Papillomavirus
LVRNFKSDK

SEQ ID NO: 40787 - protein, 10 aa, Artificial Sequence
  Peptide Derived from Human Papillomavirus
MCKHYRRAQK

SEQ ID NO: 40788 - protein, 11 aa, Artificial Sequence
  Peptide Derived from Human Papillomavirus
MCKHYRRAQKR

SEQ ID NO: 40789 - protein, 10 aa, Artificial Sequence
  Peptide Derived from Human Papillomavirus
MGDTPEWIQR

SEQ ID NO: 40790 - protein, 9 aa, Artificial Sequence
  Peptide Derived from Human Papillomavirus
MLAVFKDTY

SEQ ID NO: 40791 - protein, 9 aa, Artificial Sequence
  Peptide Derived from Human Papillomavirus
MLIQPPKLR

SEQ ID NO: 40792 - protein, 8 aa, Artificial Sequence
  Peptide Derived from Human Papillomavirus
MNMSQWIR

SEQ ID NO: 40793 - protein, 10 aa, Artificial Sequence
  Peptide Derived from Human Papillomavirus
MNMSQWIRFR

SEQ ID NO: 40794 - protein, 8 aa, Artificial Sequence
  Peptide Derived from Human Papillomavirus
MSQWIRFR

SEQ ID NO: 40795 - protein, 11 aa, Artificial Sequence
  Peptide Derived from Human Papillomavirus
MSQWIRFRCSK

SEQ ID NO: 40796 - protein, 8 aa, Artificial Sequence
  Peptide Derived from Human Papillomavirus
NCQAKYLK

SEQ ID NO: 40797 - protein, 10 aa, Artificial Sequence
  Peptide Derived from Human Papillomavirus
NDAQVLHVLK

SEQ ID NO: 40798 - protein, 11 aa, Artificial Sequence
  Peptide Derived from Human Papillomavirus
NDAQVLHVLKR

SEQ ID NO: 40799 - protein, 11 aa, Artificial Sequence
  Peptide Derived from Human Papillomavirus
NDKNWKCFFER

SEQ ID NO: 40800 - protein, 11 aa, Artificial Sequence
  Peptide Derived from Human Papillomavirus
NGNPVYEINDK

SEQ ID NO: 40801 - protein, 9 aa, Artificial Sequence
  Peptide Derived from Human Papillomavirus
NIHPAKDNR

SEQ ID NO: 40802 - protein, 9 aa, Artificial Sequence
  Peptide Derived from Human Papillomavirus
NMSQWIRFR

SEQ ID NO: 40803 - protein, 8 aa, Artificial Sequence
  Peptide Derived from Human Papillomavirus
NSGQKKAK

SEQ ID NO: 40804 - protein, 9 aa, Artificial Sequence
  Peptide Derived from Human Papillomavirus
NSGQKKAKR

SEQ ID NO: 40805 - protein, 10 aa, Artificial Sequence
  Peptide Derived from Human Papillomavirus
NSGQKKAKRR

SEQ ID NO: 40806 - protein, 9 aa, Artificial Sequence
  Peptide Derived from Human Papillomavirus
NSNAAAFLK

SEQ ID NO: 40807 - protein, 9 aa, Artificial Sequence
  Peptide Derived from Human Papillomavirus
PAKDNRWPY

SEQ ID NO: 40808 - protein, 8 aa, Artificial Sequence
  Peptide Derived from Human Papillomavirus
PANTGKSY

SEQ ID NO: 40809 - protein, 10 aa, Artificial Sequence
  Peptide Derived from Human Papillomavirus
PFDKNGNPVY

SEQ ID NO: 40810 - protein, 8 aa, Artificial Sequence
  Peptide Derived from Human Papillomavirus
PFGTFKLR

SEQ ID NO: 40811 - protein, 9 aa, Artificial Sequence
  Peptide Derived from Human Papillomavirus
PILLTTNIH

SEQ ID NO: 40812 - protein, 8 aa, Artificial Sequence
  Peptide Derived from Human Papillomavirus
PISIDRKH

SEQ ID NO: 40813 - protein, 9 aa, Artificial Sequence
  Peptide Derived from Human Papillomavirus
PISIDRKHK

SEQ ID NO: 40814 - protein, 8 aa, Artificial Sequence
  Peptide Derived from Human Papillomavirus
PIVQFLRY

SEQ ID NO: 40815 - protein, 8 aa, Artificial Sequence
  Peptide Derived from Human Papillomavirus
PNAFPFDK

SEQ ID NO: 40816 - protein, 8 aa, Artificial Sequence
  Peptide Derived from Human Papillomavirus
PTIAEGFK

SEQ ID NO: 40817 - protein, 8 aa, Artificial Sequence
  Peptide Derived from Human Papillomavirus
PVYEINDK

SEQ ID NO: 40818 - protein, 11 aa, Artificial Sequence
  Peptide Derived from Human Papillomavirus
PVYEINDKNWK

SEQ ID NO: 40819 - protein, 10 aa, Artificial Sequence
  Peptide Derived from Human Papillomavirus
QALFHAQEVH

SEQ ID NO: 40820 - protein, 8 aa, Artificial Sequence
  Peptide Derived from Human Papillomavirus
QCTIAQLK

SEQ ID NO: 40821 - protein, 9 aa, Artificial Sequence
  Peptide Derived from Human Papillomavirus
QGAMLAVFK

SEQ ID NO: 40822 - protein, 10 aa, Artificial Sequence
  Peptide Derived from Human Papillomavirus
QIQVTTNGEH

SEQ ID NO: 40823 - protein, 11 aa, Artificial Sequence
  Peptide Derived from Human Papillomavirus
QLKDLLKVNNK

SEQ ID NO: 40824 - protein, 9 aa, Artificial Sequence
  Peptide Derived from Human Papillomavirus
QMNMSQWIR

SEQ ID NO: 40825 - protein, 11 aa, Artificial Sequence
  Peptide Derived from Human Papillomavirus
QMNMSQWIRFR

SEQ ID NO: 40826 - protein, 8 aa, Artificial Sequence
  Peptide Derived from Human Papillomavirus
QVLHVLKR

SEQ ID NO: 40827 - protein, 9 aa, Artificial Sequence
  Peptide Derived from Human Papillomavirus
QVLHVLKRK

SEQ ID NO: 40828 - protein, 8 aa, Artificial Sequence
  Peptide Derived from Human Papillomavirus
QVTTNGEH

SEQ ID NO: 40829 - protein, 11 aa, Artificial Sequence
  Peptide Derived from Human Papillomavirus
RLEVDTELSPR

SEQ ID NO: 40830 - protein, 10 aa, Artificial Sequence
  Peptide Derived from Human Papillomavirus
RLFTISDSGY

SEQ ID NO: 40831 - protein, 8 aa, Artificial Sequence
  Peptide Derived from Human Papillomavirus
RSSVAALY

SEQ ID NO: 40832 - protein, 10 aa, Artificial Sequence
  Peptide Derived from Human Papillomavirus
RSSVAALYWY

SEQ ID NO: 40833 - protein, 11 aa, Artificial Sequence
  Peptide Derived from Human Papillomavirus
RSSVAALYWYR

SEQ ID NO: 40834 - protein, 9 aa, Artificial Sequence
  Peptide Derived from Human Papillomavirus
RTWSRLDLH

SEQ ID NO: 40835 - protein, 8 aa, Artificial Sequence
  Peptide Derived from Human Papillomavirus
SFLKGTPK

SEQ ID NO: 40836 - protein, 9 aa, Artificial Sequence
  Peptide Derived from Human Papillomavirus
SFLKGTPKK

SEQ ID NO: 40837 - protein, 10 aa, Artificial Sequence
  Peptide Derived from Human Papillomavirus
SFTDLVRNFK

SEQ ID NO: 40838 - protein, 8 aa, Artificial Sequence
  Peptide Derived from Human Papillomavirus
SFVNSTSH

SEQ ID NO: 40839 - protein, 8 aa, Artificial Sequence
  Peptide Derived from Human Papillomavirus
SGQKKAKR

SEQ ID NO: 40840 - protein, 9 aa, Artificial Sequence
  Peptide Derived from Human Papillomavirus
SGQKKAKRR

SEQ ID NO: 40841 - protein, 8 aa, Artificial Sequence
  Peptide Derived from Human Papillomavirus
SLNSGQKK

SEQ ID NO: 40842 - protein, 10 aa, Artificial Sequence
  Peptide Derived from Human Papillomavirus
SLNSGQKKAK

SEQ ID NO: 40843 - protein, 11 aa, Artificial Sequence
  Peptide Derived from Human Papillomavirus
SLNSGQKKAKR

SEQ ID NO: 40844 - protein, 8 aa, Artificial Sequence
  Peptide Derived from Human Papillomavirus
SNAAAFLK

SEQ ID NO: 40845 - protein, 9 aa, Artificial Sequence
  Peptide Derived from Human Papillomavirus
SNCQAKYLK

SEQ ID NO: 40846 - protein, 10 aa, Artificial Sequence
  Peptide Derived from Human Papillomavirus
SNSNAAAFLK

SEQ ID NO: 40847 - protein, 9 aa, Artificial Sequence
  Peptide Derived from Human Papillomavirus
SSVAALYWY

SEQ ID NO: 40848 - protein, 10 aa, Artificial Sequence
  Peptide Derived from Human Papillomavirus
SSVAALYWYR

SEQ ID NO: 40849 - protein, 10 aa, Artificial Sequence
  Peptide Derived from Human Papillomavirus
STENSPLGER

SEQ ID NO: 40850 - protein, 8 aa, Artificial Sequence
  Peptide Derived from Human Papillomavirus
SVAALYWY

SEQ ID NO: 40851 - protein, 9 aa, Artificial Sequence
  Peptide Derived from Human Papillomavirus
SVAALYWYR

SEQ ID NO: 40852 - protein, 9 aa, Artificial Sequence
  Peptide Derived from Human Papillomavirus
TCMLIQPPK

SEQ ID NO: 40853 - protein, 11 aa, Artificial Sequence
  Peptide Derived from Human Papillomavirus
TCMLIQPPKLR

SEQ ID NO: 40854 - protein, 9 aa, Artificial Sequence
  Peptide Derived from Human Papillomavirus
TCWTYFDTY

SEQ ID NO: 40855 - protein, 11 aa, Artificial Sequence
  Peptide Derived from Human Papillomavirus
TCWTYFDTYMR

SEQ ID NO: 40856 - protein, 10 aa, Artificial Sequence
  Peptide Derived from Human Papillomavirus
TDESDMAFEY

SEQ ID NO: 40857 - protein, 8 aa, Artificial Sequence
  Peptide Derived from Human Papillomavirus
TDLVRNFK

SEQ ID NO: 40858 - protein, 11 aa, Artificial Sequence
  Peptide Derived from Human Papillomavirus
TDLVRNFKSDK

SEQ ID NO: 40859 - protein, 10 aa, Artificial Sequence
  Peptide Derived from Human Papillomavirus
TFKLRAGQNH

SEQ ID NO: 40860 - protein, 11 aa, Artificial Sequence
  Peptide Derived from Human Papillomavirus
TFKLRAGQNHR

SEQ ID NO: 40861 - protein, 11 aa, Artificial Sequence
  Peptide Derived from Human Papillomavirus
TFLGALKSFLK

SEQ ID NO: 40862 - protein, 8 aa, Artificial Sequence
  Peptide Derived from Human Papillomavirus
TGCNGWFY

SEQ ID NO: 40863 - protein, 10 aa, Artificial Sequence
  Peptide Derived from Human Papillomavirus
TIAQLKDLLK

SEQ ID NO: 40864 - protein, 9 aa, Artificial Sequence
  Peptide Derived from Human Papillomavirus
TLIQPFILY

SEQ ID NO: 40865 - protein, 11 aa, Artificial Sequence
  Peptide Derived from Human Papillomavirus
TLIQPFILYAH

SEQ ID NO: 40866 - protein, 8 aa, Artificial Sequence
  Peptide Derived from Human Papillomavirus
TMCKHYRR

SEQ ID NO: 40867 - protein, 11 aa, Artificial Sequence
  Peptide Derived from Human Papillomavirus
TMCKHYRRAQK

SEQ ID NO: 40868 - protein, 10 aa, Artificial Sequence
  Peptide Derived from Human Papillomavirus
TNIHPAKDNR

SEQ ID NO: 40869 - protein, 10 aa, Artificial Sequence
  Peptide Derived from Human Papillomavirus
TTCWTYFDTY

SEQ ID NO: 40870 - protein, 8 aa, Artificial Sequence
  Peptide Derived from Human Papillomavirus
TTNIHPAK

SEQ ID NO: 40871 - protein, 11 aa, Artificial Sequence
  Peptide Derived from Human Papillomavirus
TTNIHPAKDNR

SEQ ID NO: 40872 - protein, 11 aa, Artificial Sequence
  Peptide Derived from Human Papillomavirus
TTTCWTYFDTY

SEQ ID NO: 40873 - protein, 11 aa, Artificial Sequence
  Peptide Derived from Human Papillomavirus
TVAKGLSTLLH

SEQ ID NO: 40874 - protein, 8 aa, Artificial Sequence
  Peptide Derived from Human Papillomavirus
VAALYWYR

SEQ ID NO: 40875 - protein, 10 aa, Artificial Sequence
  Peptide Derived from Human Papillomavirus
VAKGLSTLLH

SEQ ID NO: 40876 - protein, 8 aa, Artificial Sequence
  Peptide Derived from Human Papillomavirus
VDTELSPR

SEQ ID NO: 40877 - protein, 10 aa, Artificial Sequence
  Peptide Derived from Human Papillomavirus
VFCGPANTGK

SEQ ID NO: 40878 - protein, 10 aa, Artificial Sequence
  Peptide Derived from Human Papillomavirus
VISFVNSTSH

SEQ ID NO: 40879 - protein, 8 aa, Artificial Sequence
  Peptide Derived from Human Papillomavirus
VLHVLKRK

SEQ ID NO: 40880 - protein, 8 aa, Artificial Sequence
  Peptide Derived from Human Papillomavirus
VLILALLR

SEQ ID NO: 40881 - protein, 9 aa, Artificial Sequence
  Peptide Derived from Human Papillomavirus
VLILALLRY

SEQ ID NO: 40882 - protein, 10 aa, Artificial Sequence
  Peptide Derived from Human Papillomavirus
VLILALLRYK

SEQ ID NO: 40883 - protein, 11 aa, Artificial Sequence
  Peptide Derived from Human Papillomavirus
VMGDTPEWIQR

SEQ ID NO: 40884 - protein, 11 aa, Artificial Sequence
  Peptide Derived from Human Papillomavirus
VNPQCTIAQLK

SEQ ID NO: 40885 - protein, 10 aa, Artificial Sequence
  Peptide Derived from Human Papillomavirus
VNPTIAEGFK

SEQ ID NO: 40886 - protein, 10 aa, Artificial Sequence
  Peptide Derived from Human Papillomavirus
WFYVQAIVDK

SEQ ID NO: 40887 - protein, 11 aa, Artificial Sequence
  Peptide Derived from Human Papillomavirus
WFYVQAIVDKK

SEQ ID NO: 40888 - protein, 10 aa, Artificial Sequence
  Peptide Derived from Human Papillomavirus
WGVLILALLR

SEQ ID NO: 40889 - protein, 11 aa, Artificial Sequence
  Peptide Derived from Human Papillomavirus
WGVLILALLRY

SEQ ID NO: 40890 - protein, 10 aa, Artificial Sequence
  Peptide Derived from Human Papillomavirus
WIQRLTIIQH

SEQ ID NO: 40891 - protein, 8 aa, Artificial Sequence
  Peptide Derived from Human Papillomavirus
WIRFRCSK

SEQ ID NO: 40892 - protein, 9 aa, Artificial Sequence
  Peptide Derived from Human Papillomavirus
WLEPLTDTK

SEQ ID NO: 40893 - protein, 9 aa, Artificial Sequence
  Peptide Derived from Human Papillomavirus
WTYFDTYMR

SEQ ID NO: 40894 - protein, 10 aa, Artificial Sequence
  Peptide Derived from Human Papillomavirus
YAHIQCLDCK

SEQ ID NO: 40895 - protein, 8 aa, Artificial Sequence
  Peptide Derived from Human Papillomavirus
YFGMSFIH

SEQ ID NO: 40896 - protein, 10 aa, Artificial Sequence
  Peptide Derived from Human Papillomavirus
YGLSFTDLVR

SEQ ID NO: 40897 - protein, 10 aa, Artificial Sequence
  Peptide Derived from Human Papillomavirus
YLKDCATMCK

SEQ ID NO: 40898 - protein, 11 aa, Artificial Sequence
  Peptide Derived from Human Papillomavirus
YLKDCATMCKH

SEQ ID NO: 40899 - protein, 8 aa, Artificial Sequence
  Peptide Derived from Human Papillomavirus
YVQAIVDK

SEQ ID NO: 40900 - protein, 9 aa, Artificial Sequence
  Peptide Derived from Human Papillomavirus
YVQAIVDKK

SEQ ID NO: 40901 - protein, 9 aa, Artificial Sequence
  Peptide Derived from Human Papillomavirus
AATPTGNNK

SEQ ID NO: 40902 - protein, 10 aa, Artificial Sequence
  Peptide Derived from Human Papillomavirus
AATPTGNNKR

SEQ ID NO: 40903 - protein, 11 aa, Artificial Sequence
  Peptide Derived from Human Papillomavirus
AATPTGNNKRR

SEQ ID NO: 40904 - protein, 9 aa, Artificial Sequence
  Peptide Derived from Human Papillomavirus
AIFFAAREH

SEQ ID NO: 40905 - protein, 9 aa, Artificial Sequence
  Peptide Derived from Human Papillomavirus
ALQGLAQSR

SEQ ID NO: 40906 - protein, 10 aa, Artificial Sequence
  Peptide Derived from Human Papillomavirus
ALQGLAQSRY

SEQ ID NO: 40907 - protein, 11 aa, Artificial Sequence
  Peptide Derived from Human Papillomavirus
ALQGLAQSRYK

SEQ ID NO: 40908 - protein, 10 aa, Artificial Sequence
  Peptide Derived from Human Papillomavirus
ATCVSHRGLY

SEQ ID NO: 40909 - protein, 11 aa, Artificial Sequence
  Peptide Derived from Human Papillomavirus
ATCVSHRGLYY

SEQ ID NO: 40910 - protein, 8 aa, Artificial Sequence
  Peptide Derived from Human Papillomavirus
ATPTGNNK

SEQ ID NO: 40911 - protein, 9 aa, Artificial Sequence
  Peptide Derived from Human Papillomavirus
ATPTGNNKR

SEQ ID NO: 40912 - protein, 10 aa, Artificial Sequence
  Peptide Derived from Human Papillomavirus
ATPTGNNKRR

SEQ ID NO: 40913 - protein, 11 aa, Artificial Sequence
  Peptide Derived from Human Papillomavirus
ATPTGNNKRRK

SEQ ID NO: 40914 - protein, 10 aa, Artificial Sequence
  Peptide Derived from Human Papillomavirus
ATQLVKQLQH

SEQ ID NO: 40915 - protein, 8 aa, Artificial Sequence
  Peptide Derived from Human Papillomavirus
CGLAEKQH

SEQ ID NO: 40916 - protein, 8 aa, Artificial Sequence
  Peptide Derived from Human Papillomavirus
CLRYRLRK

SEQ ID NO: 40917 - protein, 9 aa, Artificial Sequence
  Peptide Derived from Human Papillomavirus
CLRYRLRKH

SEQ ID NO: 40918 - protein, 11 aa, Artificial Sequence
  Peptide Derived from Human Papillomavirus
CMTYVAWDSVY

SEQ ID NO: 40919 - protein, 10 aa, Artificial Sequence
  Peptide Derived from Human Papillomavirus
CSGNTTPIIH

SEQ ID NO: 40920 - protein, 9 aa, Artificial Sequence
  Peptide Derived from Human Papillomavirus
CVQDKIIDH

SEQ ID NO: 40921 - protein, 10 aa, Artificial Sequence
  Peptide Derived from Human Papillomavirus
CVQDKIIDHY

SEQ ID NO: 40922 - protein, 8 aa, Artificial Sequence
  Peptide Derived from Human Papillomavirus
CVSHRGLY

SEQ ID NO: 40923 - protein, 9 aa, Artificial Sequence
  Peptide Derived from Human Papillomavirus
CVSHRGLYY

SEQ ID NO: 40924 - protein, 11 aa, Artificial Sequence
  Peptide Derived from Human Papillomavirus
CVSHRGLYYVK

SEQ ID NO: 40925 - protein, 11 aa, Artificial Sequence
  Peptide Derived from Human Papillomavirus
DDTVSATQLVK

SEQ ID NO: 40926 - protein, 10 aa, Artificial Sequence
  Peptide Derived from Human Papillomavirus
DGNKDNCMTY

SEQ ID NO: 40927 - protein, 8 aa, Artificial Sequence
  Peptide Derived from Human Papillomavirus
DIDSQIQY

SEQ ID NO: 40928 - protein, 11 aa, Artificial Sequence
  Peptide Derived from Human Papillomavirus
DSKDIDSQIQY

SEQ ID NO: 40929 - protein, 11 aa, Artificial Sequence
  Peptide Derived from Human Papillomavirus
DSQIQYWQLIR

SEQ ID NO: 40930 - protein, 9 aa, Artificial Sequence
  Peptide Derived from Human Papillomavirus
DSVQILVGY

SEQ ID NO: 40931 - protein, 10 aa, Artificial Sequence
  Peptide Derived from Human Papillomavirus
DTVSATQLVK

SEQ ID NO: 40932 - protein, 8 aa, Artificial Sequence
  Peptide Derived from Human Papillomavirus
EFKSECEK

SEQ ID NO: 40933 - protein, 9 aa, Artificial Sequence
  Peptide Derived from Human Papillomavirus
EFKSECEKY

SEQ ID NO: 40934 - protein, 11 aa, Artificial Sequence
  Peptide Derived from Human Papillomavirus
EGYNTFYIEFK

SEQ ID NO: 40935 - protein, 9 aa, Artificial Sequence
  Peptide Derived from Human Papillomavirus
ELWNTEPTH

SEQ ID NO: 40936 - protein, 9 aa, Artificial Sequence
  Peptide Derived from Human Papillomavirus
ENAIFFAAR

SEQ ID NO: 40937 - protein, 11 aa, Artificial Sequence
  Peptide Derived from Human Papillomavirus
ENAIFFAAREH

SEQ ID NO: 40938 - protein, 11 aa, Artificial Sequence
  Peptide Derived from Human Papillomavirus
FDGNKDNCMTY

SEQ ID NO: 40939 - protein, 10 aa, Artificial Sequence
  Peptide Derived from Human Papillomavirus
GAATPTGNNK

SEQ ID NO: 40940 - protein, 11 aa, Artificial Sequence
  Peptide Derived from Human Papillomavirus
GAATPTGNNKR

SEQ ID NO: 40941 - protein, 10 aa, Artificial Sequence
  Peptide Derived from Human Papillomavirus
GDRNSLKCLR

SEQ ID NO: 40942 - protein, 11 aa, Artificial Sequence
  Peptide Derived from Human Papillomavirus
GDRNSLKCLRY

SEQ ID NO: 40943 - protein, 8 aa, Artificial Sequence
  Peptide Derived from Human Papillomavirus
GGQTVQVY

SEQ ID NO: 40944 - protein, 8 aa, Artificial Sequence
  Peptide Derived from Human Papillomavirus
GILTVTYH

SEQ ID NO: 40945 - protein, 8 aa, Artificial Sequence
  Peptide Derived from Human Papillomavirus
GLAQSRYK

SEQ ID NO: 40946 - protein, 9 aa, Artificial Sequence
  Peptide Derived from Human Papillomavirus
GLYYVKEGY

SEQ ID NO: 40947 - protein, 9 aa, Artificial Sequence
  Peptide Derived from Human Papillomavirus
GNKDNCMTY

SEQ ID NO: 40948 - protein, 9 aa, Artificial Sequence
  Peptide Derived from Human Papillomavirus
GNTGTWEVH

SEQ ID NO: 40949 - protein, 8 aa, Artificial Sequence
  Peptide Derived from Human Papillomavirus
GNTTPIIH

SEQ ID NO: 40950 - protein, 10 aa, Artificial Sequence
  Peptide Derived from Human Papillomavirus
GNTTPIIHLK

SEQ ID NO: 40951 - protein, 9 aa, Artificial Sequence
  Peptide Derived from Human Papillomavirus
HCGLAEKQH

SEQ ID NO: 40952 - protein, 8 aa, Artificial Sequence
  Peptide Derived from Human Papillomavirus
HGIQTLNH

SEQ ID NO: 40953 - protein, 10 aa, Artificial Sequence
  Peptide Derived from Human Papillomavirus
HLKGDRNSLK

SEQ ID NO: 40954 - protein, 8 aa, Artificial Sequence
  Peptide Derived from Human Papillomavirus
HSETQRTK

SEQ ID NO: 40955 - protein, 9 aa, Artificial Sequence
  Peptide Derived from Human Papillomavirus
IDHYENDSK

SEQ ID NO: 40956 - protein, 8 aa, Artificial Sequence
  Peptide Derived from Human Papillomavirus
IFFAAREH

SEQ ID NO: 40957 - protein, 10 aa, Artificial Sequence
  Peptide Derived from Human Papillomavirus
IIDHYENDSK

SEQ ID NO: 40958 - protein, 8 aa, Artificial Sequence
  Peptide Derived from Human Papillomavirus
IIHLKGDR

SEQ ID NO: 40959 - protein, 8 aa, Artificial Sequence
  Peptide Derived from Human Papillomavirus
ISKSKAHK

SEQ ID NO: 40960 - protein, 8 aa, Artificial Sequence
  Peptide Derived from Human Papillomavirus
KCLRYRLR

SEQ ID NO: 40961 - protein, 9 aa, Artificial Sequence
  Peptide Derived from Human Papillomavirus
KCLRYRLRK

SEQ ID NO: 40962 - protein, 10 aa, Artificial Sequence
  Peptide Derived from Human Papillomavirus
KCLRYRLRKH

SEQ ID NO: 40963 - protein, 9 aa, Artificial Sequence
  Peptide Derived from Human Papillomavirus
KDIDSQIQY

SEQ ID NO: 40964 - protein, 8 aa, Artificial Sequence
  Peptide Derived from Human Papillomavirus
KGDRNSLK

SEQ ID NO: 40965 - protein, 11 aa, Artificial Sequence
  Peptide Derived from Human Papillomavirus
KGDRNSLKCLR

SEQ ID NO: 40966 - protein, 9 aa, Artificial Sequence
  Peptide Derived from Human Papillomavirus
KGGQTVQVY

SEQ ID NO: 40967 - protein, 11 aa, Artificial Sequence
  Peptide Derived from Human Papillomavirus
KIIDHYENDSK

SEQ ID NO: 40968 - protein, 8 aa, Artificial Sequence
  Peptide Derived from Human Papillomavirus
KTATCVSH

SEQ ID NO: 40969 - protein, 9 aa, Artificial Sequence
  Peptide Derived from Human Papillomavirus
KTATCVSHR

SEQ ID NO: 40970 - protein, 9 aa, Artificial Sequence
  Peptide Derived from Human Papillomavirus
KTGILTVTY

SEQ ID NO: 40971 - protein, 10 aa, Artificial Sequence
  Peptide Derived from Human Papillomavirus
KTGILTVTYH

SEQ ID NO: 40972 - protein, 11 aa, Artificial Sequence
  Peptide Derived from Human Papillomavirus
KTYGQTSAATR

SEQ ID NO: 40973 - protein, 11 aa, Artificial Sequence
  Peptide Derived from Human Papillomavirus
LCSGNTTPIIH

SEQ ID NO: 40974 - protein, 11 aa, Artificial Sequence
  Peptide Derived from Human Papillomavirus
LGAATPTGNNK

SEQ ID NO: 40975 - protein, 9 aa, Artificial Sequence
  Peptide Derived from Human Papillomavirus
LNHQVVPAY

SEQ ID NO: 40976 - protein, 11 aa, Artificial Sequence
  Peptide Derived from Human Papillomavirus
LSCVQDKIIDH

SEQ ID NO: 40977 - protein, 11 aa, Artificial Sequence
  Peptide Derived from Human Papillomavirus
LSERLSCVQDK

SEQ ID NO: 40978 - protein, 11 aa, Artificial Sequence
  Peptide Derived from Human Papillomavirus
LTVTYHSETQR

SEQ ID NO: 40979 - protein, 10 aa, Artificial Sequence
  Peptide Derived from Human Papillomavirus
MALQGLAQSR

SEQ ID NO: 40980 - protein, 11 aa, Artificial Sequence
  Peptide Derived from Human Papillomavirus
MALQGLAQSRY

SEQ ID NO: 40981 - protein, 9 aa, Artificial Sequence
  Peptide Derived from Human Papillomavirus
MTDAGTWDK

SEQ ID NO: 40982 - protein, 10 aa, Artificial Sequence
  Peptide Derived from Human Papillomavirus
MTYVAWDSVY

SEQ ID NO: 40983 - protein, 11 aa, Artificial Sequence
  Peptide Derived from Human Papillomavirus
MTYVAWDSVYY

SEQ ID NO: 40984 - protein, 8 aa, Artificial Sequence
  Peptide Derived from Human Papillomavirus
NAIFFAAR

SEQ ID NO: 40985 - protein, 10 aa, Artificial Sequence
  Peptide Derived from Human Papillomavirus
NAIFFAAREH

SEQ ID NO: 40986 - protein, 8 aa, Artificial Sequence
  Peptide Derived from Human Papillomavirus
NISKSKAH

SEQ ID NO: 40987 - protein, 9 aa, Artificial Sequence
  Peptide Derived from Human Papillomavirus
NISKSKAHK

SEQ ID NO: 40988 - protein, 8 aa, Artificial Sequence
  Peptide Derived from Human Papillomavirus
NSLKCLRY

SEQ ID NO: 40989 - protein, 9 aa, Artificial Sequence
  Peptide Derived from Human Papillomavirus
NSLKCLRYR

SEQ ID NO: 40990 - protein, 11 aa, Artificial Sequence
  Peptide Derived from Human Papillomavirus
NSLKCLRYRLR

SEQ ID NO: 40991 - protein, 9 aa, Artificial Sequence
  Peptide Derived from Human Papillomavirus
NTEPTHCFK

SEQ ID NO: 40992 - protein, 10 aa, Artificial Sequence
  Peptide Derived from Human Papillomavirus
NTEPTHCFKK

SEQ ID NO: 40993 - protein, 8 aa, Artificial Sequence
  Peptide Derived from Human Papillomavirus
NTFYIEFK

SEQ ID NO: 40994 - protein, 8 aa, Artificial Sequence
  Peptide Derived from Human Papillomavirus
NTGTWEVH

SEQ ID NO: 40995 - protein, 9 aa, Artificial Sequence
  Peptide Derived from Human Papillomavirus
NTTPIIHLK

SEQ ID NO: 40996 - protein, 9 aa, Artificial Sequence
  Peptide Derived from Human Papillomavirus
PAYNISKSK

SEQ ID NO: 40997 - protein, 11 aa, Artificial Sequence
  Peptide Derived from Human Papillomavirus
PAYNISKSKAH

SEQ ID NO: 40998 - protein, 10 aa, Artificial Sequence
  Peptide Derived from Human Papillomavirus
PDSVQILVGY

SEQ ID NO: 40999 - protein, 9 aa, Artificial Sequence
  Peptide Derived from Human Papillomavirus
PGHCGLAEK

SEQ ID NO: 41000 - protein, 11 aa, Artificial Sequence
  Peptide Derived from Human Papillomavirus
PGHCGLAEKQH

SEQ ID NO: 41001 - protein, 9 aa, Artificial Sequence
  Peptide Derived from Human Papillomavirus
PIIHLKGDR

SEQ ID NO: 41002 - protein, 8 aa, Artificial Sequence
  Peptide Derived from Human Papillomavirus
PTGNNKRR

SEQ ID NO: 41003 - protein, 9 aa, Artificial Sequence
  Peptide Derived from Human Papillomavirus
PTGNNKRRK

SEQ ID NO: 41004 - protein, 8 aa, Artificial Sequence
  Peptide Derived from Human Papillomavirus
QDKIIDHY

SEQ ID NO: 41005 - protein, 8 aa, Artificial Sequence
  Peptide Derived from Human Papillomavirus
QGLAQSRY

SEQ ID NO: 41006 - protein, 9 aa, Artificial Sequence
  Peptide Derived from Human Papillomavirus
QGLAQSRYK

SEQ ID NO: 41007 - protein, 9 aa, Artificial Sequence
  Peptide Derived from Human Papillomavirus
QIQYWQLIR

SEQ ID NO: 41008 - protein, 9 aa, Artificial Sequence
  Peptide Derived from Human Papillomavirus
QLQHTPSPY

SEQ ID NO: 41009 - protein, 8 aa, Artificial Sequence
  Peptide Derived from Human Papillomavirus
QLVKQLQH

SEQ ID NO: 41010 - protein, 11 aa, Artificial Sequence
  Peptide Derived from Human Papillomavirus
QMALQGLAQSR

SEQ ID NO: 41011 - protein, 11 aa, Artificial Sequence
  Peptide Derived from Human Papillomavirus
QTLNHQVVPAY

SEQ ID NO: 41012 - protein, 10 aa, Artificial Sequence
  Peptide Derived from Human Papillomavirus
QTPKETLSER

SEQ ID NO: 41013 - protein, 10 aa, Artificial Sequence
  Peptide Derived from Human Papillomavirus
QTSAATRPGH

SEQ ID NO: 41014 - protein, 11 aa, Artificial Sequence
  Peptide Derived from Human Papillomavirus
QTVQVYFDGNK

SEQ ID NO: 41015 - protein, 10 aa, Artificial Sequence
  Peptide Derived from Human Papillomavirus
QVVPAYNISK

SEQ ID NO: 41016 - protein, 8 aa, Artificial Sequence
  Peptide Derived from Human Papillomavirus
QVYFDGNK

SEQ ID NO: 41017 - protein, 8 aa, Artificial Sequence
  Peptide Derived from Human Papillomavirus
RDISSTWH

SEQ ID NO: 41018 - protein, 10 aa, Artificial Sequence
  Peptide Derived from Human Papillomavirus
RGLYYVKEGY

SEQ ID NO: 41019 - protein, 8 aa, Artificial Sequence
  Peptide Derived from Human Papillomavirus
RLRKHSDH

SEQ ID NO: 41020 - protein, 9 aa, Artificial Sequence
  Peptide Derived from Human Papillomavirus
RLRKHSDHY

SEQ ID NO: 41021 - protein, 10 aa, Artificial Sequence
  Peptide Derived from Human Papillomavirus
RLRKHSDHYR

SEQ ID NO: 41022 - protein, 8 aa, Artificial Sequence
  Peptide Derived from Human Papillomavirus
RLSCVQDK

SEQ ID NO: 41023 - protein, 8 aa, Artificial Sequence
  Peptide Derived from Human Papillomavirus
RNSLKCLR

SEQ ID NO: 41024 - protein, 9 aa, Artificial Sequence
  Peptide Derived from Human Papillomavirus
RNSLKCLRY

SEQ ID NO: 41025 - protein, 10 aa, Artificial Sequence
  Peptide Derived from Human Papillomavirus
RNSLKCLRYR

SEQ ID NO: 41026 - protein, 8 aa, Artificial Sequence
  Peptide Derived from Human Papillomavirus
SAATRPGH

SEQ ID NO: 41027 - protein, 11 aa, Artificial Sequence
  Peptide Derived from Human Papillomavirus
SATQLVKQLQH

SEQ ID NO: 41028 - protein, 10 aa, Artificial Sequence
  Peptide Derived from Human Papillomavirus
SCVQDKIIDH

SEQ ID NO: 41029 - protein, 11 aa, Artificial Sequence
  Peptide Derived from Human Papillomavirus
SCVQDKIIDHY

SEQ ID NO: 41030 - protein, 9 aa, Artificial Sequence
  Peptide Derived from Human Papillomavirus
SGNTTPIIH

SEQ ID NO: 41031 - protein, 11 aa, Artificial Sequence
  Peptide Derived from Human Papillomavirus
SGNTTPIIHLK

SEQ ID NO: 41032 - protein, 8 aa, Artificial Sequence
  Peptide Derived from Human Papillomavirus
SLKCLRYR

SEQ ID NO: 41033 - protein, 10 aa, Artificial Sequence
  Peptide Derived from Human Papillomavirus
SLKCLRYRLR

SEQ ID NO: 41034 - protein, 11 aa, Artificial Sequence
  Peptide Derived from Human Papillomavirus
SLKCLRYRLRK

SEQ ID NO: 41035 - protein, 10 aa, Artificial Sequence
  Peptide Derived from Human Papillomavirus
SSTVSVGTAK

SEQ ID NO: 41036 - protein, 9 aa, Artificial Sequence
  Peptide Derived from Human Papillomavirus
STVSVGTAK

SEQ ID NO: 41037 - protein, 11 aa, Artificial Sequence
  Peptide Derived from Human Papillomavirus
STVSVGTAKTY

SEQ ID NO: 41038 - protein, 8 aa, Artificial Sequence
  Peptide Derived from Human Papillomavirus
SVGTAKTY

SEQ ID NO: 41039 - protein, 8 aa, Artificial Sequence
  Peptide Derived from Human Papillomavirus
SVQILVGY

SEQ ID NO: 41040 - protein, 8 aa, Artificial Sequence
  Peptide Derived from Human Papillomavirus
TATCVSHR

SEQ ID NO: 41041 - protein, 11 aa, Artificial Sequence
  Peptide Derived from Human Papillomavirus
TATCVSHRGLY

SEQ ID NO: 41042 - protein, 9 aa, Artificial Sequence
  Peptide Derived from Human Papillomavirus
TCVSHRGLY

SEQ ID NO: 41043 - protein, 10 aa, Artificial Sequence
  Peptide Derived from Human Papillomavirus
TCVSHRGLYY

SEQ ID NO: 41044 - protein, 8 aa, Artificial Sequence
  Peptide Derived from Human Papillomavirus
TDAGTWDK

SEQ ID NO: 41045 - protein, 8 aa, Artificial Sequence
  Peptide Derived from Human Papillomavirus
TGILTVTY

SEQ ID NO: 41046 - protein, 9 aa, Artificial Sequence
  Peptide Derived from Human Papillomavirus
TGILTVTYH

SEQ ID NO: 41047 - protein, 8 aa, Artificial Sequence
  Peptide Derived from Human Papillomavirus
TGNNKRRK

SEQ ID NO: 41048 - protein, 10 aa, Artificial Sequence
  Peptide Derived from Human Papillomavirus
TLNHQVVPAY

SEQ ID NO: 41049 - protein, 9 aa, Artificial Sequence
  Peptide Derived from Human Papillomavirus
TSAATRPGH

SEQ ID NO: 41050 - protein, 8 aa, Artificial Sequence
  Peptide Derived from Human Papillomavirus
TTPIIHLK

SEQ ID NO: 41051 - protein, 11 aa, Artificial Sequence
  Peptide Derived from Human Papillomavirus
TTPIIHLKGDR

SEQ ID NO: 41052 - protein, 10 aa, Artificial Sequence
  Peptide Derived from Human Papillomavirus
TVQVYFDGNK

SEQ ID NO: 41053 - protein, 9 aa, Artificial Sequence
  Peptide Derived from Human Papillomavirus
TVSATQLVK

SEQ ID NO: 41054 - protein, 8 aa, Artificial Sequence
  Peptide Derived from Human Papillomavirus
TVSVGTAK

SEQ ID NO: 41055 - protein, 10 aa, Artificial Sequence
  Peptide Derived from Human Papillomavirus
TVSVGTAKTY

SEQ ID NO: 41056 - protein, 10 aa, Artificial Sequence
  Peptide Derived from Human Papillomavirus
TVTYHSETQR

SEQ ID NO: 41057 - protein, 8 aa, Artificial Sequence
  Peptide Derived from Human Papillomavirus
VAWDSVYY

SEQ ID NO: 41058 - protein, 8 aa, Artificial Sequence
  Peptide Derived from Human Papillomavirus
VSATQLVK

SEQ ID NO: 41059 - protein, 8 aa, Artificial Sequence
  Peptide Derived from Human Papillomavirus
VSHRGLYY

SEQ ID NO: 41060 - protein, 10 aa, Artificial Sequence
  Peptide Derived from Human Papillomavirus
VSHRGLYYVK

SEQ ID NO: 41061 - protein, 9 aa, Artificial Sequence
  Peptide Derived from Human Papillomavirus
VSVGTAKTY

SEQ ID NO: 41062 - protein, 9 aa, Artificial Sequence
  Peptide Derived from Human Papillomavirus
VTYHSETQR

SEQ ID NO: 41063 - protein, 11 aa, Artificial Sequence
  Peptide Derived from Human Papillomavirus
VTYHSETQRTK

SEQ ID NO: 41064 - protein, 9 aa, Artificial Sequence
  Peptide Derived from Human Papillomavirus
VVPAYNISK

SEQ ID NO: 41065 - protein, 11 aa, Artificial Sequence
  Peptide Derived from Human Papillomavirus
VVPAYNISKSK

SEQ ID NO: 41066 - protein, 10 aa, Artificial Sequence
  Peptide Derived from Human Papillomavirus
WDKTATCVSH

SEQ ID NO: 41067 - protein, 11 aa, Artificial Sequence
  Peptide Derived from Human Papillomavirus
WDKTATCVSHR

SEQ ID NO: 41068 - protein, 10 aa, Artificial Sequence
  Peptide Derived from Human Papillomavirus
WNTEPTHCFK

SEQ ID NO: 41069 - protein, 11 aa, Artificial Sequence
  Peptide Derived from Human Papillomavirus
WNTEPTHCFKK

SEQ ID NO: 41070 - protein, 8 aa, Artificial Sequence
  Peptide Derived from Human Papillomavirus
WTGAGNEK

SEQ ID NO: 41071 - protein, 10 aa, Artificial Sequence
  Peptide Derived from Human Papillomavirus
YGNTGTWEVH

SEQ ID NO: 41072 - protein, 9 aa, Artificial Sequence
  Peptide Derived from Human Papillomavirus
YGQTSAATR

SEQ ID NO: 41073 - protein, 10 aa, Artificial Sequence
  Peptide Derived from Human Papillomavirus
YIEFKSECEK

SEQ ID NO: 41074 - protein, 11 aa, Artificial Sequence
  Peptide Derived from Human Papillomavirus
YIEFKSECEKY

SEQ ID NO: 41075 - protein, 10 aa, Artificial Sequence
  Peptide Derived from Human Papillomavirus
YMTDAGTWDK

SEQ ID NO: 41076 - protein, 9 aa, Artificial Sequence
  Peptide Derived from Human Papillomavirus
YNISKSKAH

SEQ ID NO: 41077 - protein, 10 aa, Artificial Sequence
  Peptide Derived from Human Papillomavirus
YNISKSKAHK

SEQ ID NO: 41078 - protein, 9 aa, Artificial Sequence
  Peptide Derived from Human Papillomavirus
YNTFYIEFK

SEQ ID NO: 41079 - protein, 11 aa, Artificial Sequence
  Peptide Derived from Human Papillomavirus
YSSTVSVGTAK

SEQ ID NO: 41080 - protein, 8 aa, Artificial Sequence
  Peptide Derived from Human Papillomavirus
YVAWDSVY

SEQ ID NO: 41081 - protein, 9 aa, Artificial Sequence
  Peptide Derived from Human Papillomavirus
YVAWDSVYY

SEQ ID NO: 41082 - protein, 10 aa, Artificial Sequence
  Peptide Derived from Human Papillomavirus
YVKEGYNTFY

SEQ ID NO: 41083 - protein, 11 aa, Artificial Sequence
  Peptide Derived from Human Papillomavirus
CAYAWVLVFVY

SEQ ID NO: 41084 - protein, 11 aa, Artificial Sequence
  Peptide Derived from Human Papillomavirus
CFCVCMYVCCH

SEQ ID NO: 41085 - protein, 10 aa, Artificial Sequence
  Peptide Derived from Human Papillomavirus
CFLLPMLLLH

SEQ ID NO: 41086 - protein, 9 aa, Artificial Sequence
  Peptide Derived from Human Papillomavirus
CVCMYVCCH

SEQ ID NO: 41087 - protein, 8 aa, Artificial Sequence
  Peptide Derived from Human Papillomavirus
FCFCVCMY

SEQ ID NO: 41088 - protein, 11 aa, Artificial Sequence
  Peptide Derived from Human Papillomavirus
FCFLLPMLLLH

SEQ ID NO: 41089 - protein, 10 aa, Artificial Sequence
  Peptide Derived from Human Papillomavirus
FCVCMYVCCH

SEQ ID NO: 41090 - protein, 10 aa, Artificial Sequence
  Peptide Derived from Human Papillomavirus
FLFCFCVCMY

SEQ ID NO: 41091 - protein, 9 aa, Artificial Sequence
  Peptide Derived from Human Papillomavirus
FLLPMLLLH

SEQ ID NO: 41092 - protein, 11 aa, Artificial Sequence
  Peptide Derived from Human Papillomavirus
FLLPMLLLHIH

SEQ ID NO: 41093 - protein, 11 aa, Artificial Sequence
  Peptide Derived from Human Papillomavirus
IFLFCFCVCMY

SEQ ID NO: 41094 - protein, 11 aa, Artificial Sequence
  Peptide Derived from Human Papillomavirus
ITSPATAFTVY

SEQ ID NO: 41095 - protein, 9 aa, Artificial Sequence
  Peptide Derived from Human Papillomavirus
LFCFCVCMY

SEQ ID NO: 41096 - protein, 8 aa, Artificial Sequence
  Peptide Derived from Human Papillomavirus
LLPMLLLH

SEQ ID NO: 41097 - protein, 10 aa, Artificial Sequence
  Peptide Derived from Human Papillomavirus
LLPMLLLHIH

SEQ ID NO: 41098 - protein, 10 aa, Artificial Sequence
  Peptide Derived from Human Papillomavirus
LLPSVCMCAY

SEQ ID NO: 41099 - protein, 8 aa, Artificial Sequence
  Peptide Derived from Human Papillomavirus
PATAFTVY

SEQ ID NO: 41100 - protein, 11 aa, Artificial Sequence
  Peptide Derived from Human Papillomavirus
PLLPSVCMCAY

SEQ ID NO: 41101 - protein, 8 aa, Artificial Sequence
  Peptide Derived from Human Papillomavirus
PMLLLHIH

SEQ ID NO: 41102 - protein, 8 aa, Artificial Sequence
  Peptide Derived from Human Papillomavirus
PSVCMCAY

SEQ ID NO: 41103 - protein, 10 aa, Artificial Sequence
  Peptide Derived from Human Papillomavirus
TSPATAFTVY

SEQ ID NO: 41104 - protein, 8 aa, Artificial Sequence
  Peptide Derived from Human Papillomavirus
VCMYVCCH

SEQ ID NO: 41105 - protein, 9 aa, Artificial Sequence
  Peptide Derived from Human Papillomavirus
YAWVLVFVY

SEQ ID NO: 41106 - protein, 10 aa, Artificial Sequence
  Peptide Derived from Human Papillomavirus
AACHKCIDFY

SEQ ID NO: 41107 - protein, 9 aa, Artificial Sequence
  Peptide Derived from Human Papillomavirus
ACHKCIDFY

SEQ ID NO: 41108 - protein, 11 aa, Artificial Sequence
  Peptide Derived from Human Papillomavirus
ACHKCIDFYSR

SEQ ID NO: 41109 - protein, 9 aa, Artificial Sequence
  Peptide Derived from Human Papillomavirus
AFKDLFVVY

SEQ ID NO: 41110 - protein, 10 aa, Artificial Sequence
  Peptide Derived from Human Papillomavirus
AFKDLFVVYR

SEQ ID NO: 41111 - protein, 9 aa, Artificial Sequence
  Peptide Derived from Human Papillomavirus
AGHYRGQCH

SEQ ID NO: 41112 - protein, 9 aa, Artificial Sequence
  Peptide Derived from Human Papillomavirus
CCNRARQER

SEQ ID NO: 41113 - protein, 9 aa, Artificial Sequence
  Peptide Derived from Human Papillomavirus
CIDFYSRIR

SEQ ID NO: 41114 - protein, 8 aa, Artificial Sequence
  Peptide Derived from Human Papillomavirus
CNRARQER

SEQ ID NO: 41115 - protein, 11 aa, Artificial Sequence
  Peptide Derived from Human Papillomavirus
CNRARQERLQR

SEQ ID NO: 41116 - protein, 10 aa, Artificial Sequence
  Peptide Derived from Human Papillomavirus
DFYSRIRELR

SEQ ID NO: 41117 - protein, 11 aa, Artificial Sequence
  Peptide Derived from Human Papillomavirus
DFYSRIRELRH

SEQ ID NO: 41118 - protein, 8 aa, Artificial Sequence
  Peptide Derived from Human Papillomavirus
DIEITCVY

SEQ ID NO: 41119 - protein, 10 aa, Artificial Sequence
  Peptide Derived from Human Papillomavirus
DIEITCVYCK

SEQ ID NO: 41120 - protein, 9 aa, Artificial Sequence
  Peptide Derived from Human Papillomavirus
DSIPHAACH

SEQ ID NO: 41121 - protein, 10 aa, Artificial Sequence
  Peptide Derived from Human Papillomavirus
DSIPHAACHK

SEQ ID NO: 41122 - protein, 10 aa, Artificial Sequence
  Peptide Derived from Human Papillomavirus
DSVYGDTLEK

SEQ ID NO: 41123 - protein, 8 aa, Artificial Sequence
  Peptide Derived from Human Papillomavirus
EDPTRRPY

SEQ ID NO: 41124 - protein, 9 aa, Artificial Sequence
  Peptide Derived from Human Papillomavirus
EDPTRRPYK

SEQ ID NO: 41125 - protein, 11 aa, Artificial Sequence
  Peptide Derived from Human Papillomavirus
EFAFKDLFVVY

SEQ ID NO: 41126 - protein, 8 aa, Artificial Sequence
  Peptide Derived from Human Papillomavirus
EITCVYCK

SEQ ID NO: 41127 - protein, 10 aa, Artificial Sequence
  Peptide Derived from Human Papillomavirus
ELRHYSDSVY

SEQ ID NO: 41128 - protein, 11 aa, Artificial Sequence
  Peptide Derived from Human Papillomavirus
ELTEVFEFAFK

SEQ ID NO: 41129 - protein, 8 aa, Artificial Sequence
  Peptide Derived from Human Papillomavirus
EVFEFAFK

SEQ ID NO: 41130 - protein, 10 aa, Artificial Sequence
  Peptide Derived from Human Papillomavirus
FAFKDLFVVY

SEQ ID NO: 41131 - protein, 11 aa, Artificial Sequence
  Peptide Derived from Human Papillomavirus
FAFKDLFVVYR

SEQ ID NO: 41132 - protein, 10 aa, Artificial Sequence
  Peptide Derived from Human Papillomavirus
FVVYRDSIPH

SEQ ID NO: 41133 - protein, 8 aa, Artificial Sequence
  Peptide Derived from Human Papillomavirus
GLYNLLIR

SEQ ID NO: 41134 - protein, 11 aa, Artificial Sequence
  Peptide Derived from Human Papillomavirus
GLYNLLIRCLR

SEQ ID NO: 41135 - protein, 11 aa, Artificial Sequence
  Peptide Derived from Human Papillomavirus
HAACHKCIDFY

SEQ ID NO: 41136 - protein, 9 aa, Artificial Sequence
  Peptide Derived from Human Papillomavirus
HLNEKRRFH

SEQ ID NO: 41137 - protein, 8 aa, Artificial Sequence
  Peptide Derived from Human Papillomavirus
HNIAGHYR

SEQ ID NO: 41138 - protein, 8 aa, Artificial Sequence
  Peptide Derived from Human Papillomavirus
HSCCNRAR

SEQ ID NO: 41139 - protein, 11 aa, Artificial Sequence
  Peptide Derived from Human Papillomavirus
HSCCNRARQER

SEQ ID NO: 41140 - protein, 10 aa, Artificial Sequence
  Peptide Derived from Human Papillomavirus
IAGHYRGQCH

SEQ ID NO: 41141 - protein, 8 aa, Artificial Sequence
  Peptide Derived from Human Papillomavirus
IDFYSRIR

SEQ ID NO: 41142 - protein, 11 aa, Artificial Sequence
  Peptide Derived from Human Papillomavirus
IDFYSRIRELR

SEQ ID NO: 41143 - protein, 8 aa, Artificial Sequence
  Peptide Derived from Human Papillomavirus
KCIDFYSR

SEQ ID NO: 41144 - protein, 10 aa, Artificial Sequence
  Peptide Derived from Human Papillomavirus
KCIDFYSRIR

SEQ ID NO: 41145 - protein, 8 aa, Artificial Sequence
  Peptide Derived from Human Papillomavirus
KDLFVVYR

SEQ ID NO: 41146 - protein, 8 aa, Artificial Sequence
  Peptide Derived from Human Papillomavirus
KLRHLNEK

SEQ ID NO: 41147 - protein, 9 aa, Artificial Sequence
  Peptide Derived from Human Papillomavirus
KLRHLNEKR

SEQ ID NO: 41148 - protein, 10 aa, Artificial Sequence
  Peptide Derived from Human Papillomavirus
KLRHLNEKRR

SEQ ID NO: 41149 - protein, 8 aa, Artificial Sequence
  Peptide Derived from Human Papillomavirus
KLTNTGLY

SEQ ID NO: 41150 - protein, 11 aa, Artificial Sequence
  Peptide Derived from Human Papillomavirus
LFVVYRDSIPH

SEQ ID NO: 41151 - protein, 9 aa, Artificial Sequence
  Peptide Derived from Human Papillomavirus
LIRCLRCQK

SEQ ID NO: 41152 - protein, 10 aa, Artificial Sequence
  Peptide Derived from Human Papillomavirus
LLIRCLRCQK

SEQ ID NO: 41153 - protein, 8 aa, Artificial Sequence
  Peptide Derived from Human Papillomavirus
LNEKRRFH

SEQ ID NO: 41154 - protein, 8 aa, Artificial Sequence
  Peptide Derived from Human Papillomavirus
LNPAEKLR

SEQ ID NO: 41155 - protein, 9 aa, Artificial Sequence
  Peptide Derived from Human Papillomavirus
LNPAEKLRH

SEQ ID NO: 41156 - protein, 10 aa, Artificial Sequence
  Peptide Derived from Human Papillomavirus
LTEVFEFAFK

SEQ ID NO: 41157 - protein, 9 aa, Artificial Sequence
  Peptide Derived from Human Papillomavirus
MARFEDPTR

SEQ ID NO: 41158 - protein, 10 aa, Artificial Sequence
  Peptide Derived from Human Papillomavirus
MARFEDPTRR

SEQ ID NO: 41159 - protein, 11 aa, Artificial Sequence
  Peptide Derived from Human Papillomavirus
NIAGHYRGQCH

SEQ ID NO: 41160 - protein, 8 aa, Artificial Sequence
  Peptide Derived from Human Papillomavirus
NLLIRCLR

SEQ ID NO: 41161 - protein, 11 aa, Artificial Sequence
  Peptide Derived from Human Papillomavirus
NLLIRCLRCQK

SEQ ID NO: 41162 - protein, 10 aa, Artificial Sequence
  Peptide Derived from Human Papillomavirus
NTGLYNLLIR

SEQ ID NO: 41163 - protein, 11 aa, Artificial Sequence
  Peptide Derived from Human Papillomavirus
PAEKLRHLNEK

SEQ ID NO: 41164 - protein, 9 aa, Artificial Sequence
  Peptide Derived from Human Papillomavirus
PLNPAEKLR

SEQ ID NO: 41165 - protein, 10 aa, Artificial Sequence
  Peptide Derived from Human Papillomavirus
PLNPAEKLRH

SEQ ID NO: 41166 - protein, 8 aa, Artificial Sequence
  Peptide Derived from Human Papillomavirus
QCHSCCNR

SEQ ID NO: 41167 - protein, 10 aa, Artificial Sequence
  Peptide Derived from Human Papillomavirus
QCHSCCNRAR

SEQ ID NO: 41168 - protein, 9 aa, Artificial Sequence
  Peptide Derived from Human Papillomavirus
QDIEITCVY

SEQ ID NO: 41169 - protein, 11 aa, Artificial Sequence
  Peptide Derived from Human Papillomavirus
QDIEITCVYCK

SEQ ID NO: 41170 - protein, 9 aa, Artificial Sequence
  Peptide Derived from Human Papillomavirus
RARQERLQR

SEQ ID NO: 41171 - protein, 10 aa, Artificial Sequence
  Peptide Derived from Human Papillomavirus
RARQERLQRR

SEQ ID NO: 41172 - protein, 11 aa, Artificial Sequence
  Peptide Derived from Human Papillomavirus
RARQERLQRRR

SEQ ID NO: 41173 - protein, 11 aa, Artificial Sequence
  Peptide Derived from Human Papillomavirus
RCQKPLNPAEK

SEQ ID NO: 41174 - protein, 10 aa, Artificial Sequence
  Peptide Derived from Human Papillomavirus
RDSIPHAACH

SEQ ID NO: 41175 - protein, 11 aa, Artificial Sequence
  Peptide Derived from Human Papillomavirus
RDSIPHAACHK

SEQ ID NO: 41176 - protein, 8 aa, Artificial Sequence
  Peptide Derived from Human Papillomavirus
RFEDPTRR

SEQ ID NO: 41177 - protein, 10 aa, Artificial Sequence
  Peptide Derived from Human Papillomavirus
RFEDPTRRPY

SEQ ID NO: 41178 - protein, 11 aa, Artificial Sequence
  Peptide Derived from Human Papillomavirus
RFEDPTRRPYK

SEQ ID NO: 41179 - protein, 8 aa, Artificial Sequence
  Peptide Derived from Human Papillomavirus
RFHNIAGH

SEQ ID NO: 41180 - protein, 9 aa, Artificial Sequence
  Peptide Derived from Human Papillomavirus
RFHNIAGHY

SEQ ID NO: 41181 - protein, 10 aa, Artificial Sequence
  Peptide Derived from Human Papillomavirus
RFHNIAGHYR

SEQ ID NO: 41182 - protein, 10 aa, Artificial Sequence
  Peptide Derived from Human Papillomavirus
RGQCHSCCNR

SEQ ID NO: 41183 - protein, 8 aa, Artificial Sequence
  Peptide Derived from Human Papillomavirus
RIRELRHY

SEQ ID NO: 41184 - protein, 10 aa, Artificial Sequence
  Peptide Derived from Human Papillomavirus
SCCNRARQER

SEQ ID NO: 41185 - protein, 11 aa, Artificial Sequence
  Peptide Derived from Human Papillomavirus
SDSVYGDTLEK

SEQ ID NO: 41186 - protein, 8 aa, Artificial Sequence
  Peptide Derived from Human Papillomavirus
SIPHAACH

SEQ ID NO: 41187 - protein, 9 aa, Artificial Sequence
  Peptide Derived from Human Papillomavirus
SIPHAACHK

SEQ ID NO: 41188 - protein, 11 aa, Artificial Sequence
  Peptide Derived from Human Papillomavirus
SLQDIEITCVY

SEQ ID NO: 41189 - protein, 9 aa, Artificial Sequence
  Peptide Derived from Human Papillomavirus
SVYGDTLEK

SEQ ID NO: 41190 - protein, 9 aa, Artificial Sequence
  Peptide Derived from Human Papillomavirus
TGLYNLLIR

SEQ ID NO: 41191 - protein, 11 aa, Artificial Sequence
  Peptide Derived from Human Papillomavirus
TLEKLTNTGLY

SEQ ID NO: 41192 - protein, 11 aa, Artificial Sequence
  Peptide Derived from Human Papillomavirus
TNTGLYNLLIR

SEQ ID NO: 41193 - protein, 9 aa, Artificial Sequence
  Peptide Derived from Human Papillomavirus
VVYRDSIPH

SEQ ID NO: 41194 - protein, 9 aa, Artificial Sequence
  Peptide Derived from Human Papillomavirus
YNLLIRCLR

SEQ ID NO: 41195 - protein, 8 aa, Artificial Sequence
  Peptide Derived from Human Papillomavirus
YSRIRELR

SEQ ID NO: 41196 - protein, 9 aa, Artificial Sequence
  Peptide Derived from Human Papillomavirus
YSRIRELRH

SEQ ID NO: 41197 - protein, 10 aa, Artificial Sequence
  Peptide Derived from Human Papillomavirus
YSRIRELRHY

SEQ ID NO: 41198 - protein, 9 aa, Artificial Sequence
  Peptide Derived from Human Papillomavirus
ATLQDIVLH

SEQ ID NO: 41199 - protein, 9 aa, Artificial Sequence
  Peptide Derived from Human Papillomavirus
CCKCEARIK

SEQ ID NO: 41200 - protein, 9 aa, Artificial Sequence
  Peptide Derived from Human Papillomavirus
CMCCKCEAR

SEQ ID NO: 41201 - protein, 11 aa, Artificial Sequence
  Peptide Derived from Human Papillomavirus
CMCCKCEARIK

SEQ ID NO: 41202 - protein, 11 aa, Artificial Sequence
  Peptide Derived from Human Papillomavirus
DGVNHQHLPAR

SEQ ID NO: 41203 - protein, 9 aa, Artificial Sequence
  Peptide Derived from Human Papillomavirus
EIDGVNHQH

SEQ ID NO: 41204 - protein, 9 aa, Artificial Sequence
  Peptide Derived from Human Papillomavirus
EIPVDLLCH

SEQ ID NO: 41205 - protein, 10 aa, Artificial Sequence
  Peptide Derived from Human Papillomavirus
ENDEIDGVNH

SEQ ID NO: 41206 - protein, 8 aa, Artificial Sequence
  Peptide Derived from Human Papillomavirus
ESSADDLR

SEQ ID NO: 41207 - protein, 10 aa, Artificial Sequence
  Peptide Derived from Human Papillomavirus
GVNHQHLPAR

SEQ ID NO: 41208 - protein, 11 aa, Artificial Sequence
  Peptide Derived from Human Papillomavirus
GVNHQHLPARR

SEQ ID NO: 41209 - protein, 11 aa, Artificial Sequence
  Peptide Derived from Human Papillomavirus
HLPARRAEPQR

SEQ ID NO: 41210 - protein, 9 aa, Artificial Sequence
  Peptide Derived from Human Papillomavirus
HTMLCMCCK

SEQ ID NO: 41211 - protein, 8 aa, Artificial Sequence
  Peptide Derived from Human Papillomavirus
IDGVNHQH

SEQ ID NO: 41212 - protein, 10 aa, Artificial Sequence
  Peptide Derived from Human Papillomavirus
KATLQDIVLH

SEQ ID NO: 41213 - protein, 10 aa, Artificial Sequence
  Peptide Derived from Human Papillomavirus
LCMCCKCEAR

SEQ ID NO: 41214 - protein, 11 aa, Artificial Sequence
  Peptide Derived from Human Papillomavirus
LVVESSADDLR

SEQ ID NO: 41215 - protein, 8 aa, Artificial Sequence
  Peptide Derived from Human Papillomavirus
MCCKCEAR

SEQ ID NO: 41216 - protein, 10 aa, Artificial Sequence
  Peptide Derived from Human Papillomavirus
MCCKCEARIK

SEQ ID NO: 41217 - protein, 11 aa, Artificial Sequence
  Peptide Derived from Human Papillomavirus
MLCMCCKCEAR

SEQ ID NO: 41218 - protein, 9 aa, Artificial Sequence
  Peptide Derived from Human Papillomavirus
NDEIDGVNH

SEQ ID NO: 41219 - protein, 11 aa, Artificial Sequence
  Peptide Derived from Human Papillomavirus
NDEIDGVNHQH

SEQ ID NO: 41220 - protein, 9 aa, Artificial Sequence
  Peptide Derived from Human Papillomavirus
PARRAEPQR

SEQ ID NO: 41221 - protein, 10 aa, Artificial Sequence
  Peptide Derived from Human Papillomavirus
PARRAEPQRH

SEQ ID NO: 41222 - protein, 11 aa, Artificial Sequence
  Peptide Derived from Human Papillomavirus
QNEIPVDLLCH

SEQ ID NO: 41223 - protein, 8 aa, Artificial Sequence
  Peptide Derived from Human Papillomavirus
TLQDIVLH

SEQ ID NO: 41224 - protein, 8 aa, Artificial Sequence
  Peptide Derived from Human Papillomavirus
TMLCMCCK

SEQ ID NO: 41225 - protein, 9 aa, Artificial Sequence
  Peptide Derived from Human Papillomavirus
VNHQHLPAR

SEQ ID NO: 41226 - protein, 10 aa, Artificial Sequence
  Peptide Derived from Human Papillomavirus
VNHQHLPARR

SEQ ID NO: 41227 - protein, 10 aa, Artificial Sequence
  Peptide Derived from Human Papillomavirus
VVESSADDLR

SEQ ID NO: 41228 - protein, 10 aa, Artificial Sequence
  Peptide Derived from Human Papillomavirus
AAPAENKDPY

SEQ ID NO: 41229 - protein, 11 aa, Artificial Sequence
  Peptide Derived from Human Papillomavirus
AATSNVSEDVR

SEQ ID NO: 41230 - protein, 9 aa, Artificial Sequence
  Peptide Derived from Human Papillomavirus
ACAGVEIGR

SEQ ID NO: 41231 - protein, 8 aa, Artificial Sequence
  Peptide Derived from Human Papillomavirus
ADVMSYIH

SEQ ID NO: 41232 - protein, 11 aa, Artificial Sequence
  Peptide Derived from Human Papillomavirus
AGGGNKQDIPK

SEQ ID NO: 41233 - protein, 8 aa, Artificial Sequence
  Peptide Derived from Human Papillomavirus
AIGEHWAK

SEQ ID NO: 41234 - protein, 11 aa, Artificial Sequence
  Peptide Derived from Human Papillomavirus
ALWRPSDNTVY

SEQ ID NO: 41235 - protein, 11 aa, Artificial Sequence
  Peptide Derived from Human Papillomavirus
AMDFSTLQDTK

SEQ ID NO: 41236 - protein, 8 aa, Artificial Sequence
  Peptide Derived from Human Papillomavirus
ASPGSCVY

SEQ ID NO: 41237 - protein, 11 aa, Artificial Sequence
  Peptide Derived from Human Papillomavirus
ASTQSPVPGQY

SEQ ID NO: 41238 - protein, 9 aa, Artificial Sequence
  Peptide Derived from Human Papillomavirus
ATKFKQYSR

SEQ ID NO: 41239 - protein, 10 aa, Artificial Sequence
  Peptide Derived from Human Papillomavirus
ATKFKQYSRH

SEQ ID NO: 41240 - protein, 10 aa, Artificial Sequence
  Peptide Derived from Human Papillomavirus
ATSNVSEDVR

SEQ ID NO: 41241 - protein, 9 aa, Artificial Sequence
  Peptide Derived from Human Papillomavirus
ATTSSKPAK

SEQ ID NO: 41242 - protein, 10 aa, Artificial Sequence
  Peptide Derived from Human Papillomavirus
ATTSSKPAKR

SEQ ID NO: 41243 - protein, 8 aa, Artificial Sequence
  Peptide Derived from Human Papillomavirus
CAGVEIGR

SEQ ID NO: 41244 - protein, 8 aa, Artificial Sequence
  Peptide Derived from Human Papillomavirus
CAPAIGEH

SEQ ID NO: 41245 - protein, 11 aa, Artificial Sequence
  Peptide Derived from Human Papillomavirus
CAPAIGEHWAK

SEQ ID NO: 41246 - protein, 10 aa, Artificial Sequence
  Peptide Derived from Human Papillomavirus
CGHYIILFLR

SEQ ID NO: 41247 - protein, 10 aa, Artificial Sequence
  Peptide Derived from Human Papillomavirus
CLRREQLFAR

SEQ ID NO: 41248 - protein, 11 aa, Artificial Sequence
  Peptide Derived from Human Papillomavirus
CLRREQLFARH

SEQ ID NO: 41249 - protein, 10 aa, Artificial Sequence
  Peptide Derived from Human Papillomavirus
CLYTRVLILH

SEQ ID NO: 41250 - protein, 11 aa, Artificial Sequence
  Peptide Derived from Human Papillomavirus
CLYTRVLILHY

SEQ ID NO: 41251 - protein, 8 aa, Artificial Sequence
  Peptide Derived from Human Papillomavirus
DAAPAENK

SEQ ID NO: 41252 - protein, 11 aa, Artificial Sequence
  Peptide Derived from Human Papillomavirus
DAAPAENKDPY

SEQ ID NO: 41253 - protein, 8 aa, Artificial Sequence
  Peptide Derived from Human Papillomavirus
DATKFKQY

SEQ ID NO: 41254 - protein, 10 aa, Artificial Sequence
  Peptide Derived from Human Papillomavirus
DATKFKQYSR

SEQ ID NO: 41255 - protein, 11 aa, Artificial Sequence
  Peptide Derived from Human Papillomavirus
DATKFKQYSRH

SEQ ID NO: 41256 - protein, 8 aa, Artificial Sequence
  Peptide Derived from Human Papillomavirus
DCPPLELK

SEQ ID NO: 41257 - protein, 11 aa, Artificial Sequence
  Peptide Derived from Human Papillomavirus
DDYVTPTSIFY

SEQ ID NO: 41258 - protein, 9 aa, Artificial Sequence
  Peptide Derived from Human Papillomavirus
DFSTLQDTK

SEQ ID NO: 41259 - protein, 9 aa, Artificial Sequence
  Peptide Derived from Human Papillomavirus
DGDMVDTGY

SEQ ID NO: 41260 - protein, 8 aa, Artificial Sequence
  Peptide Derived from Human Papillomavirus
DICQSICK

SEQ ID NO: 41261 - protein, 9 aa, Artificial Sequence
  Peptide Derived from Human Papillomavirus
DICQSICKY

SEQ ID NO: 41262 - protein, 8 aa, Artificial Sequence
  Peptide Derived from Human Papillomavirus
DIPKVSAY

SEQ ID NO: 41263 - protein, 10 aa, Artificial Sequence
  Peptide Derived from Human Papillomavirus
DIPKVSAYQY

SEQ ID NO: 41264 - protein, 11 aa, Artificial Sequence
  Peptide Derived from Human Papillomavirus
DIPKVSAYQYR

SEQ ID NO: 41265 - protein, 9 aa, Artificial Sequence
  Peptide Derived from Human Papillomavirus
DLDQYPLGR

SEQ ID NO: 41266 - protein, 10 aa, Artificial Sequence
  Peptide Derived from Human Papillomavirus
DLDQYPLGRK

SEQ ID NO: 41267 - protein, 8 aa, Artificial Sequence
  Peptide Derived from Human Papillomavirus
DNVSVDYK

SEQ ID NO: 41268 - protein, 8 aa, Artificial Sequence
  Peptide Derived from Human Papillomavirus
DSMFFCLR

SEQ ID NO: 41269 - protein, 9 aa, Artificial Sequence
  Peptide Derived from Human Papillomavirus
DSMFFCLRR

SEQ ID NO: 41270 - protein, 9 aa, Artificial Sequence
  Peptide Derived from Human Papillomavirus
DSQLFNKPY

SEQ ID NO: 41271 - protein, 11 aa, Artificial Sequence
  Peptide Derived from Human Papillomavirus
DTSIYNPETQR

SEQ ID NO: 41272 - protein, 8 aa, Artificial Sequence
  Peptide Derived from Human Papillomavirus
DTVPQSLY

SEQ ID NO: 41273 - protein, 10 aa, Artificial Sequence
  Peptide Derived from Human Papillomavirus
DTVPQSLYIK

SEQ ID NO: 41274 - protein, 10 aa, Artificial Sequence
  Peptide Derived from Human Papillomavirus
DVRDNVSVDY

SEQ ID NO: 41275 - protein, 11 aa, Artificial Sequence
  Peptide Derived from Human Papillomavirus
DVRDNVSVDYK

SEQ ID NO: 41276 - protein, 10 aa, Artificial Sequence
  Peptide Derived from Human Papillomavirus
EDGDMVDTGY

SEQ ID NO: 41277 - protein, 11 aa, Artificial Sequence
  Peptide Derived from Human Papillomavirus
EDVRDNVSVDY

SEQ ID NO: 41278 - protein, 8 aa, Artificial Sequence
  Peptide Derived from Human Papillomavirus
ENKDPYDK

SEQ ID NO: 41279 - protein, 10 aa, Artificial Sequence
  Peptide Derived from Human Papillomavirus
ENKDPYDKLK

SEQ ID NO: 41280 - protein, 8 aa, Artificial Sequence
  Peptide Derived from Human Papillomavirus
FARHFWNR

SEQ ID NO: 41281 - protein, 11 aa, Artificial Sequence
  Peptide Derived from Human Papillomavirus
FCLRREQLFAR

SEQ ID NO: 41282 - protein, 9 aa, Artificial Sequence
  Peptide Derived from Human Papillomavirus
FGLPDTSIY

SEQ ID NO: 41283 - protein, 8 aa, Artificial Sequence
  Peptide Derived from Human Papillomavirus
FLQMALWR

SEQ ID NO: 41284 - protein, 8 aa, Artificial Sequence
  Peptide Derived from Human Papillomavirus
FLVQAGLR

SEQ ID NO: 41285 - protein, 9 aa, Artificial Sequence
  Peptide Derived from Human Papillomavirus
FLVQAGLRR

SEQ ID NO: 41286 - protein, 10 aa, Artificial Sequence
  Peptide Derived from Human Papillomavirus
FLVQAGLRRK

SEQ ID NO: 41287 - protein, 8 aa, Artificial Sequence
  Peptide Derived from Human Papillomavirus
FNKPYWLH

SEQ ID NO: 41288 - protein, 9 aa, Artificial Sequence
  Peptide Derived from Human Papillomavirus
FNKPYWLHK

SEQ ID NO: 41289 - protein, 8 aa, Artificial Sequence
  Peptide Derived from Human Papillomavirus
FSLDLDQY

SEQ ID NO: 41290 - protein, 8 aa, Artificial Sequence
  Peptide Derived from Human Papillomavirus
FSTLQDTK

SEQ ID NO: 41291 - protein, 11 aa, Artificial Sequence
  Peptide Derived from Human Papillomavirus
FVQSVAITCQK

SEQ ID NO: 41292 - protein, 9 aa, Artificial Sequence
  Peptide Derived from Human Papillomavirus
GCAPAIGEH

SEQ ID NO: 41293 - protein, 9 aa, Artificial Sequence
  Peptide Derived from Human Papillomavirus
GDCPPLELK

SEQ ID NO: 41294 - protein, 8 aa, Artificial Sequence
  Peptide Derived from Human Papillomavirus
GDMVDTGY

SEQ ID NO: 41295 - protein, 9 aa, Artificial Sequence
  Peptide Derived from Human Papillomavirus
GDSMFFCLR

SEQ ID NO: 41296 - protein, 10 aa, Artificial Sequence
  Peptide Derived from Human Papillomavirus
GDSMFFCLRR

SEQ ID NO: 41297 - protein, 9 aa, Artificial Sequence
  Peptide Derived from Human Papillomavirus
GDTVPQSLY

SEQ ID NO: 41298 - protein, 11 aa, Artificial Sequence
  Peptide Derived from Human Papillomavirus
GDTVPQSLYIK

SEQ ID NO: 41299 - protein, 10 aa, Artificial Sequence
  Peptide Derived from Human Papillomavirus
GGGNKQDIPK

SEQ ID NO: 41300 - protein, 9 aa, Artificial Sequence
  Peptide Derived from Human Papillomavirus
GGNKQDIPK

SEQ ID NO: 41301 - protein, 8 aa, Artificial Sequence
  Peptide Derived from Human Papillomavirus
GLPDTSIY

SEQ ID NO: 41302 - protein, 11 aa, Artificial Sequence
  Peptide Derived from Human Papillomavirus
GLRRKPTIGPR

SEQ ID NO: 41303 - protein, 8 aa, Artificial Sequence
  Peptide Derived from Human Papillomavirus
GLSGHPFY

SEQ ID NO: 41304 - protein, 10 aa, Artificial Sequence
  Peptide Derived from Human Papillomavirus
GLSGHPFYNK

SEQ ID NO: 41305 - protein, 11 aa, Artificial Sequence
  Peptide Derived from Human Papillomavirus
GMPASPGSCVY

SEQ ID NO: 41306 - protein, 8 aa, Artificial Sequence
  Peptide Derived from Human Papillomavirus
GNKQDIPK

SEQ ID NO: 41307 - protein, 10 aa, Artificial Sequence
  Peptide Derived from Human Papillomavirus
GVGLSGHPFY

SEQ ID NO: 41308 - protein, 8 aa, Artificial Sequence
  Peptide Derived from Human Papillomavirus
HIIICGHY

SEQ ID NO: 41309 - protein, 10 aa, Artificial Sequence
  Peptide Derived from Human Papillomavirus
HLLPLYGPLY

SEQ ID NO: 41310 - protein, 11 aa, Artificial Sequence
  Peptide Derived from Human Papillomavirus
HLLPLYGPLYH

SEQ ID NO: 41311 - protein, 8 aa, Artificial Sequence
  Peptide Derived from Human Papillomavirus
HNNGVCWH

SEQ ID NO: 41312 - protein, 9 aa, Artificial Sequence
  Peptide Derived from Human Papillomavirus
HSILVYMVH

SEQ ID NO: 41313 - protein, 11 aa, Artificial Sequence
  Peptide Derived from Human Papillomavirus
ICGHYIILFLR

SEQ ID NO: 41314 - protein, 8 aa, Artificial Sequence
  Peptide Derived from Human Papillomavirus
ICQSICKY

SEQ ID NO: 41315 - protein, 11 aa, Artificial Sequence
  Peptide Derived from Human Papillomavirus
ICQSICKYPDY

SEQ ID NO: 41316 - protein, 9 aa, Artificial Sequence
  Peptide Derived from Human Papillomavirus
IFLQMALWR

SEQ ID NO: 41317 - protein, 9 aa, Artificial Sequence
  Peptide Derived from Human Papillomavirus
IFYHAGSSR

SEQ ID NO: 41318 - protein, 11 aa, Artificial Sequence
  Peptide Derived from Human Papillomavirus
ILGCAPAIGEH

SEQ ID NO: 41319 - protein, 10 aa, Artificial Sequence
  Peptide Derived from Human Papillomavirus
ILHYHLLPLY

SEQ ID NO: 41320 - protein, 10 aa, Artificial Sequence
  Peptide Derived from Human Papillomavirus
ITLTADVMSY

SEQ ID NO: 41321 - protein, 11 aa, Artificial Sequence
  Peptide Derived from Human Papillomavirus
IVTSDSQLFNK

SEQ ID NO: 41322 - protein, 9 aa, Artificial Sequence
  Peptide Derived from Human Papillomavirus
KDAAPAENK

SEQ ID NO: 41323 - protein, 8 aa, Artificial Sequence
  Peptide Derived from Human Papillomavirus
KDPYDKLK

SEQ ID NO: 41324 - protein, 10 aa, Artificial Sequence
  Peptide Derived from Human Papillomavirus
KFGLPDTSIY

SEQ ID NO: 41325 - protein, 8 aa, Artificial Sequence
  Peptide Derived from Human Papillomavirus
KFKQYSRH

SEQ ID NO: 41326 - protein, 9 aa, Artificial Sequence
  Peptide Derived from Human Papillomavirus
KFLVQAGLR

SEQ ID NO: 41327 - protein, 10 aa, Artificial Sequence
  Peptide Derived from Human Papillomavirus
KFLVQAGLRR

SEQ ID NO: 41328 - protein, 11 aa, Artificial Sequence
  Peptide Derived from Human Papillomavirus
KFLVQAGLRRK

SEQ ID NO: 41329 - protein, 9 aa, Artificial Sequence
  Peptide Derived from Human Papillomavirus
KFSLDLDQY

SEQ ID NO: 41330 - protein, 8 aa, Artificial Sequence
  Peptide Derived from Human Papillomavirus
KFWNVDLK

SEQ ID NO: 41331 - protein, 10 aa, Artificial Sequence
  Peptide Derived from Human Papillomavirus
KFWNVDLKEK

SEQ ID NO: 41332 - protein, 8 aa, Artificial Sequence
  Peptide Derived from Human Papillomavirus
KGTACKSR

SEQ ID NO: 41333 - protein, 9 aa, Artificial Sequence
  Peptide Derived from Human Papillomavirus
KLDDTESSH

SEQ ID NO: 41334 - protein, 10 aa, Artificial Sequence
  Peptide Derived from Human Papillomavirus
KLKFWNVDLK

SEQ ID NO: 41335 - protein, 8 aa, Artificial Sequence
  Peptide Derived from Human Papillomavirus
KVSAYQYR

SEQ ID NO: 41336 - protein, 11 aa, Artificial Sequence
  Peptide Derived from Human Papillomavirus
KVSAYQYRVFR

SEQ ID NO: 41337 - protein, 8 aa, Artificial Sequence
  Peptide Derived from Human Papillomavirus
LDDTESSH

SEQ ID NO: 41338 - protein, 9 aa, Artificial Sequence
  Peptide Derived from Human Papillomavirus
LDICQSICK

SEQ ID NO: 41339 - protein, 10 aa, Artificial Sequence
  Peptide Derived from Human Papillomavirus
LDICQSICKY

SEQ ID NO: 41340 - protein, 10 aa, Artificial Sequence
  Peptide Derived from Human Papillomavirus
LDLDQYPLGR

SEQ ID NO: 41341 - protein, 11 aa, Artificial Sequence
  Peptide Derived from Human Papillomavirus
LDLDQYPLGRK

SEQ ID NO: 41342 - protein, 8 aa, Artificial Sequence
  Peptide Derived from Human Papillomavirus
LDQYPLGR

SEQ ID NO: 41343 - protein, 9 aa, Artificial Sequence
  Peptide Derived from Human Papillomavirus
LDQYPLGRK

SEQ ID NO: 41344 - protein, 9 aa, Artificial Sequence
  Peptide Derived from Human Papillomavirus
LFARHFWNR

SEQ ID NO: 41345 - protein, 9 aa, Artificial Sequence
  Peptide Derived from Human Papillomavirus
LFNKPYWLH

SEQ ID NO: 41346 - protein, 10 aa, Artificial Sequence
  Peptide Derived from Human Papillomavirus
LFNKPYWLHK

SEQ ID NO: 41347 - protein, 10 aa, Artificial Sequence
  Peptide Derived from Human Papillomavirus
LGCAPAIGEH

SEQ ID NO: 41348 - protein, 8 aa, Artificial Sequence
  Peptide Derived from Human Papillomavirus
LGVGLSGH

SEQ ID NO: 41349 - protein, 11 aa, Artificial Sequence
  Peptide Derived from Human Papillomavirus
LGVGLSGHPFY

SEQ ID NO: 41350 - protein, 11 aa, Artificial Sequence
  Peptide Derived from Human Papillomavirus
LILHYHLLPLY

SEQ ID NO: 41351 - protein, 9 aa, Artificial Sequence
  Peptide Derived from Human Papillomavirus
LLPLYGPLY

SEQ ID NO: 41352 - protein, 10 aa, Artificial Sequence
  Peptide Derived from Human Papillomavirus
LLPLYGPLYH

SEQ ID NO: 41353 - protein, 8 aa, Artificial Sequence
  Peptide Derived from Human Papillomavirus
LLTVGNPY

SEQ ID NO: 41354 - protein, 10 aa, Artificial Sequence
  Peptide Derived from Human Papillomavirus
LLTVGNPYFR

SEQ ID NO: 41355 - protein, 9 aa, Artificial Sequence
  Peptide Derived from Human Papillomavirus
LSGHPFYNK

SEQ ID NO: 41356 - protein, 8 aa, Artificial Sequence
  Peptide Derived from Human Papillomavirus
LTADVMSY

SEQ ID NO: 41357 - protein, 10 aa, Artificial Sequence
  Peptide Derived from Human Papillomavirus
LTADVMSYIH

SEQ ID NO: 41358 - protein, 9 aa, Artificial Sequence
  Peptide Derived from Human Papillomavirus
LTVGNPYFR

SEQ ID NO: 41359 - protein, 8 aa, Artificial Sequence
  Peptide Derived from Human Papillomavirus
LVQAGLRR

SEQ ID NO: 41360 - protein, 9 aa, Artificial Sequence
  Peptide Derived from Human Papillomavirus
LVQAGLRRK

SEQ ID NO: 41361 - protein, 11 aa, Artificial Sequence
  Peptide Derived from Human Papillomavirus
MCLYTRVLILH

SEQ ID NO: 41362 - protein, 10 aa, Artificial Sequence
  Peptide Derived from Human Papillomavirus
MDFSTLQDTK

SEQ ID NO: 41363 - protein, 10 aa, Artificial Sequence
  Peptide Derived from Human Papillomavirus
MGDTVPQSLY

SEQ ID NO: 41364 - protein, 9 aa, Artificial Sequence
  Peptide Derived from Human Papillomavirus
MVHIIICGH

SEQ ID NO: 41365 - protein, 10 aa, Artificial Sequence
  Peptide Derived from Human Papillomavirus
MVHIIICGHY

SEQ ID NO: 41366 - protein, 8 aa, Artificial Sequence
  Peptide Derived from Human Papillomavirus
PAENKDPY

SEQ ID NO: 41367 - protein, 10 aa, Artificial Sequence
  Peptide Derived from Human Papillomavirus
PAENKDPYDK

SEQ ID NO: 41368 - protein, 9 aa, Artificial Sequence
  Peptide Derived from Human Papillomavirus
PAIGEHWAK

SEQ ID NO: 41369 - protein, 8 aa, Artificial Sequence
  Peptide Derived from Human Papillomavirus
PAKRVRVR

SEQ ID NO: 41370 - protein, 10 aa, Artificial Sequence
  Peptide Derived from Human Papillomavirus
PAKRVRVRAR

SEQ ID NO: 41371 - protein, 11 aa, Artificial Sequence
  Peptide Derived from Human Papillomavirus
PAKRVRVRARK

SEQ ID NO: 41372 - protein, 9 aa, Artificial Sequence
  Peptide Derived from Human Papillomavirus
PASPGSCVY

SEQ ID NO: 41373 - protein, 11 aa, Artificial Sequence
  Peptide Derived from Human Papillomavirus
PDYLQMSADPY

SEQ ID NO: 41374 - protein, 8 aa, Artificial Sequence
  Peptide Derived from Human Papillomavirus
PGQYDATK

SEQ ID NO: 41375 - protein, 10 aa, Artificial Sequence
  Peptide Derived from Human Papillomavirus
PGQYDATKFK

SEQ ID NO: 41376 - protein, 10 aa, Artificial Sequence
  Peptide Derived from Human Papillomavirus
PIFLQMALWR

SEQ ID NO: 41377 - protein, 10 aa, Artificial Sequence
  Peptide Derived from Human Papillomavirus
PLDICQSICK

SEQ ID NO: 41378 - protein, 11 aa, Artificial Sequence
  Peptide Derived from Human Papillomavirus
PLDICQSICKY

SEQ ID NO: 41379 - protein, 9 aa, Artificial Sequence
  Peptide Derived from Human Papillomavirus
PLGVGLSGH

SEQ ID NO: 41380 - protein, 8 aa, Artificial Sequence
  Peptide Derived from Human Papillomavirus
PLHSILVY

SEQ ID NO: 41381 - protein, 11 aa, Artificial Sequence
  Peptide Derived from Human Papillomavirus
PLHSILVYMVH

SEQ ID NO: 41382 - protein, 10 aa, Artificial Sequence
  Peptide Derived from Human Papillomavirus
PLPLHSILVY

SEQ ID NO: 41383 - protein, 8 aa, Artificial Sequence
  Peptide Derived from Human Papillomavirus
PLYGPLYH

SEQ ID NO: 41384 - protein, 10 aa, Artificial Sequence
  Peptide Derived from Human Papillomavirus
PLYGPLYHPR

SEQ ID NO: 41385 - protein, 11 aa, Artificial Sequence
  Peptide Derived from Human Papillomavirus
PLYHPRPLPLH

SEQ ID NO: 41386 - protein, 8 aa, Artificial Sequence
  Peptide Derived from Human Papillomavirus
PSATTSSK

SEQ ID NO: 41387 - protein, 11 aa, Artificial Sequence
  Peptide Derived from Human Papillomavirus
PSATTSSKPAK

SEQ ID NO: 41388 - protein, 8 aa, Artificial Sequence
  Peptide Derived from Human Papillomavirus
PTIGPRKR

SEQ ID NO: 41389 - protein, 9 aa, Artificial Sequence
  Peptide Derived from Human Papillomavirus
PTTSLVDTY

SEQ ID NO: 41390 - protein, 10 aa, Artificial Sequence
  Peptide Derived from Human Papillomavirus
PTTSLVDTYR

SEQ ID NO: 41391 - protein, 10 aa, Artificial Sequence
  Peptide Derived from Human Papillomavirus
PVPGQYDATK

SEQ ID NO: 41392 - protein, 9 aa, Artificial Sequence
  Peptide Derived from Human Papillomavirus
QDIPKVSAY

SEQ ID NO: 41393 - protein, 11 aa, Artificial Sequence
  Peptide Derived from Human Papillomavirus
QDIPKVSAYQY

SEQ ID NO: 41394 - protein, 10 aa, Artificial Sequence
  Peptide Derived from Human Papillomavirus
QGDCPPLELK

SEQ ID NO: 41395 - protein, 10 aa, Artificial Sequence
  Peptide Derived from Human Papillomavirus
QGHNNGVCWH

SEQ ID NO: 41396 - protein, 10 aa, Artificial Sequence
  Peptide Derived from Human Papillomavirus
QLFARHFWNR

SEQ ID NO: 41397 - protein, 10 aa, Artificial Sequence
  Peptide Derived from Human Papillomavirus
QLFNKPYWLH

SEQ ID NO: 41398 - protein, 11 aa, Artificial Sequence
  Peptide Derived from Human Papillomavirus
QLFNKPYWLHK

SEQ ID NO: 41399 - protein, 9 aa, Artificial Sequence
  Peptide Derived from Human Papillomavirus
QSICKYPDY

SEQ ID NO: 41400 - protein, 8 aa, Artificial Sequence
  Peptide Derived from Human Papillomavirus
QSPVPGQY

SEQ ID NO: 41401 - protein, 9 aa, Artificial Sequence
  Peptide Derived from Human Papillomavirus
QSVAITCQK

SEQ ID NO: 41402 - protein, 8 aa, Artificial Sequence
  Peptide Derived from Human Papillomavirus
RDNVSVDY

SEQ ID NO: 41403 - protein, 9 aa, Artificial Sequence
  Peptide Derived from Human Papillomavirus
RDNVSVDYK

SEQ ID NO: 41404 - protein, 9 aa, Artificial Sequence
  Peptide Derived from Human Papillomavirus
RLLTVGNPY

SEQ ID NO: 41405 - protein, 11 aa, Artificial Sequence
  Peptide Derived from Human Papillomavirus
RLLTVGNPYFR

SEQ ID NO: 41406 - protein, 11 aa, Artificial Sequence
  Peptide Derived from Human Papillomavirus
RSAPSATTSSK

SEQ ID NO: 41407 - protein, 8 aa, Artificial Sequence
  Peptide Derived from Human Papillomavirus
RVLILHYH

SEQ ID NO: 41408 - protein, 9 aa, Artificial Sequence
  Peptide Derived from Human Papillomavirus
RVPAGGGNK

SEQ ID NO: 41409 - protein, 9 aa, Artificial Sequence
  Peptide Derived from Human Papillomavirus
RVQLPDPNK

SEQ ID NO: 41410 - protein, 8 aa, Artificial Sequence
  Peptide Derived from Human Papillomavirus
RVRVRARK

SEQ ID NO: 41411 - protein, 8 aa, Artificial Sequence
  Peptide Derived from Human Papillomavirus
RVVNTDDY

SEQ ID NO: 41412 - protein, 10 aa, Artificial Sequence
  Peptide Derived from Human Papillomavirus
SAPSATTSSK

SEQ ID NO: 41413 - protein, 10 aa, Artificial Sequence
  Peptide Derived from Human Papillomavirus
SATTSSKPAK

SEQ ID NO: 41414 - protein, 11 aa, Artificial Sequence
  Peptide Derived from Human Papillomavirus
SATTSSKPAKR

SEQ ID NO: 41415 - protein, 9 aa, Artificial Sequence
  Peptide Derived from Human Papillomavirus
SAYQYRVFR

SEQ ID NO: 41416 - protein, 8 aa, Artificial Sequence
  Peptide Derived from Human Papillomavirus
SDSQLFNK

SEQ ID NO: 41417 - protein, 10 aa, Artificial Sequence
  Peptide Derived from Human Papillomavirus
SDSQLFNKPY

SEQ ID NO: 41418 - protein, 8 aa, Artificial Sequence
  Peptide Derived from Human Papillomavirus
SGHPFYNK

SEQ ID NO: 41419 - protein, 8 aa, Artificial Sequence
  Peptide Derived from Human Papillomavirus
SICKYPDY

SEQ ID NO: 41420 - protein, 10 aa, Artificial Sequence
  Peptide Derived from Human Papillomavirus
SIFYHAGSSR

SEQ ID NO: 41421 - protein, 8 aa, Artificial Sequence
  Peptide Derived from Human Papillomavirus
SILVYMVH

SEQ ID NO: 41422 - protein, 9 aa, Artificial Sequence
  Peptide Derived from Human Papillomavirus
SIYNPETQR

SEQ ID NO: 41423 - protein, 11 aa, Artificial Sequence
  Peptide Derived from Human Papillomavirus
SLDLDQYPLGR

SEQ ID NO: 41424 - protein, 8 aa, Artificial Sequence
  Peptide Derived from Human Papillomavirus
SMFFCLRR

SEQ ID NO: 41425 - protein, 8 aa, Artificial Sequence
  Peptide Derived from Human Papillomavirus
SNVSEDVR

SEQ ID NO: 41426 - protein, 9 aa, Artificial Sequence
  Peptide Derived from Human Papillomavirus
SSKPAKRVR

SEQ ID NO: 41427 - protein, 11 aa, Artificial Sequence
  Peptide Derived from Human Papillomavirus
SSKPAKRVRVR

SEQ ID NO: 41428 - protein, 11 aa, Artificial Sequence
  Peptide Derived from Human Papillomavirus
SSRLLTVGNPY

SEQ ID NO: 41429 - protein, 10 aa, Artificial Sequence
  Peptide Derived from Human Papillomavirus
STQSPVPGQY

SEQ ID NO: 41430 - protein, 8 aa, Artificial Sequence
  Peptide Derived from Human Papillomavirus
SVAITCQK

SEQ ID NO: 41431 - protein, 11 aa, Artificial Sequence
  Peptide Derived from Human Papillomavirus
SVARVVNTDDY

SEQ ID NO: 41432 - protein, 9 aa, Artificial Sequence
  Peptide Derived from Human Papillomavirus
TADVMSYIH

SEQ ID NO: 41433 - protein, 11 aa, Artificial Sequence
  Peptide Derived from Human Papillomavirus
TITLTADVMSY

SEQ ID NO: 41434 - protein, 9 aa, Artificial Sequence
  Peptide Derived from Human Papillomavirus
TLTADVMSY

SEQ ID NO: 41435 - protein, 11 aa, Artificial Sequence
  Peptide Derived from Human Papillomavirus
TLTADVMSYIH

SEQ ID NO: 41436 - protein, 11 aa, Artificial Sequence
  Peptide Derived from Human Papillomavirus
TMGDTVPQSLY

SEQ ID NO: 41437 - protein, 9 aa, Artificial Sequence
  Peptide Derived from Human Papillomavirus
TSDSQLFNK

SEQ ID NO: 41438 - protein, 11 aa, Artificial Sequence
  Peptide Derived from Human Papillomavirus
TSDSQLFNKPY

SEQ ID NO: 41439 - protein, 11 aa, Artificial Sequence
  Peptide Derived from Human Papillomavirus
TSIFYHAGSSR

SEQ ID NO: 41440 - protein, 10 aa, Artificial Sequence
  Peptide Derived from Human Papillomavirus
TSIYNPETQR

SEQ ID NO: 41441 - protein, 8 aa, Artificial Sequence
  Peptide Derived from Human Papillomavirus
TSLVDTYR

SEQ ID NO: 41442 - protein, 9 aa, Artificial Sequence
  Peptide Derived from Human Papillomavirus
TSNVSEDVR

SEQ ID NO: 41443 - protein, 8 aa, Artificial Sequence
  Peptide Derived from Human Papillomavirus
TSSKPAKR

SEQ ID NO: 41444 - protein, 10 aa, Artificial Sequence
  Peptide Derived from Human Papillomavirus
TSSKPAKRVR

SEQ ID NO: 41445 - protein, 8 aa, Artificial Sequence
  Peptide Derived from Human Papillomavirus
TTSLVDTY

SEQ ID NO: 41446 - protein, 9 aa, Artificial Sequence
  Peptide Derived from Human Papillomavirus
TTSLVDTYR

SEQ ID NO: 41447 - protein, 8 aa, Artificial Sequence
  Peptide Derived from Human Papillomavirus
TTSSKPAK

SEQ ID NO: 41448 - protein, 9 aa, Artificial Sequence
  Peptide Derived from Human Papillomavirus
TTSSKPAKR

SEQ ID NO: 41449 - protein, 11 aa, Artificial Sequence
  Peptide Derived from Human Papillomavirus
TTSSKPAKRVR

SEQ ID NO: 41450 - protein, 8 aa, Artificial Sequence
  Peptide Derived from Human Papillomavirus
TVGNPYFR

SEQ ID NO: 41451 - protein, 9 aa, Artificial Sequence
  Peptide Derived from Human Papillomavirus
TVPQSLYIK

SEQ ID NO: 41452 - protein, 11 aa, Artificial Sequence
  Peptide Derived from Human Papillomavirus
TVYLPPPSVAR

SEQ ID NO: 41453 - protein, 10 aa, Artificial Sequence
  Peptide Derived from Human Papillomavirus
VARVVNTDDY

SEQ ID NO: 41454 - protein, 11 aa, Artificial Sequence
  Peptide Derived from Human Papillomavirus
VFRVQLPDPNK

SEQ ID NO: 41455 - protein, 9 aa, Artificial Sequence
  Peptide Derived from Human Papillomavirus
VGLSGHPFY

SEQ ID NO: 41456 - protein, 11 aa, Artificial Sequence
  Peptide Derived from Human Papillomavirus
VGLSGHPFYNK

SEQ ID NO: 41457 - protein, 10 aa, Artificial Sequence
  Peptide Derived from Human Papillomavirus
VSAYQYRVFR

SEQ ID NO: 41458 - protein, 8 aa, Artificial Sequence
  Peptide Derived from Human Papillomavirus
VTPTSIFY

SEQ ID NO: 41459 - protein, 9 aa, Artificial Sequence
  Peptide Derived from Human Papillomavirus
VTPTSIFYH

SEQ ID NO: 41460 - protein, 10 aa, Artificial Sequence
  Peptide Derived from Human Papillomavirus
VTSDSQLFNK

SEQ ID NO: 41461 - protein, 10 aa, Artificial Sequence
  Peptide Derived from Human Papillomavirus
WACAGVEIGR

SEQ ID NO: 41462 - protein, 8 aa, Artificial Sequence
  Peptide Derived from Human Papillomavirus
WAKGTACK

SEQ ID NO: 41463 - protein, 10 aa, Artificial Sequence
  Peptide Derived from Human Papillomavirus
WAKGTACKSR

SEQ ID NO: 41464 - protein, 8 aa, Artificial Sequence
  Peptide Derived from Human Papillomavirus
WLHKAQGH

SEQ ID NO: 41465 - protein, 8 aa, Artificial Sequence
  Peptide Derived from Human Papillomavirus
WNVDLKEK

SEQ ID NO: 41466 - protein, 9 aa, Artificial Sequence
  Peptide Derived from Human Papillomavirus
YDATKFKQY

SEQ ID NO: 41467 - protein, 11 aa, Artificial Sequence
  Peptide Derived from Human Papillomavirus
YDATKFKQYSR

SEQ ID NO: 41468 - protein, 11 aa, Artificial Sequence
  Peptide Derived from Human Papillomavirus
YFRVPAGGGNK

SEQ ID NO: 41469 - protein, 10 aa, Artificial Sequence
  Peptide Derived from Human Papillomavirus
YGDSMFFCLR

SEQ ID NO: 41470 - protein, 11 aa, Artificial Sequence
  Peptide Derived from Human Papillomavirus
YGDSMFFCLRR

SEQ ID NO: 41471 - protein, 8 aa, Artificial Sequence
  Peptide Derived from Human Papillomavirus
YGPLYHPR

SEQ ID NO: 41472 - protein, 9 aa, Artificial Sequence
  Peptide Derived from Human Papillomavirus
YLPPPSVAR

SEQ ID NO: 41473 - protein, 9 aa, Artificial Sequence
  Peptide Derived from Human Papillomavirus
YLQMSADPY

SEQ ID NO: 41474 - protein, 10 aa, Artificial Sequence
  Peptide Derived from Human Papillomavirus
YMVHIIICGH

SEQ ID NO: 41475 - protein, 11 aa, Artificial Sequence
  Peptide Derived from Human Papillomavirus
YMVHIIICGHY

SEQ ID NO: 41476 - protein, 11 aa, Artificial Sequence
  Peptide Derived from Human Papillomavirus
YNKLDDTESSH

SEQ ID NO: 41477 - protein, 8 aa, Artificial Sequence
  Peptide Derived from Human Papillomavirus
YSRHVEEY

SEQ ID NO: 41478 - protein, 8 aa, Artificial Sequence
  Peptide Derived from Human Papillomavirus
YTRVLILH

SEQ ID NO: 41479 - protein, 9 aa, Artificial Sequence
  Peptide Derived from Human Papillomavirus
YTRVLILHY

SEQ ID NO: 41480 - protein, 10 aa, Artificial Sequence
  Peptide Derived from Human Papillomavirus
YTRVLILHYH

SEQ ID NO: 41481 - protein, 9 aa, Artificial Sequence
  Peptide Derived from Human Papillomavirus
YVTPTSIFY

SEQ ID NO: 41482 - protein, 10 aa, Artificial Sequence
  Peptide Derived from Human Papillomavirus
YVTPTSIFYH

SEQ ID NO: 41483 - protein, 8 aa, Artificial Sequence
  Peptide Derived from Human Papillomavirus
AGPRLYSR

SEQ ID NO: 41484 - protein, 10 aa, Artificial Sequence
  Peptide Derived from Human Papillomavirus
AGPRLYSRAY

SEQ ID NO: 41485 - protein, 10 aa, Artificial Sequence
  Peptide Derived from Human Papillomavirus
ALTSRRGTVR

SEQ ID NO: 41486 - protein, 8 aa, Artificial Sequence
  Peptide Derived from Human Papillomavirus
ANPEFLTR

SEQ ID NO: 41487 - protein, 9 aa, Artificial Sequence
  Peptide Derived from Human Papillomavirus
ASTQYIGIH

SEQ ID NO: 41488 - protein, 8 aa, Artificial Sequence
  Peptide Derived from Human Papillomavirus
ASVTDLYK

SEQ ID NO: 41489 - protein, 11 aa, Artificial Sequence
  Peptide Derived from Human Papillomavirus
ASVTDLYKTCK

SEQ ID NO: 41490 - protein, 11 aa, Artificial Sequence
  Peptide Derived from Human Papillomavirus
ATEDNDLFDIY

SEQ ID NO: 41491 - protein, 9 aa, Artificial Sequence
  Peptide Derived from Human Papillomavirus
DFMDIIRLH

SEQ ID NO: 41492 - protein, 10 aa, Artificial Sequence
  Peptide Derived from Human Papillomavirus
DFMDIIRLHR

SEQ ID NO: 41493 - protein, 11 aa, Artificial Sequence
  Peptide Derived from Human Papillomavirus
DISPIAPSPEY

SEQ ID NO: 41494 - protein, 11 aa, Artificial Sequence
  Peptide Derived from Human Papillomavirus
DMDPAVPVPSR

SEQ ID NO: 41495 - protein, 8 aa, Artificial Sequence
  Peptide Derived from Human Papillomavirus
DNDLFDIY

SEQ ID NO: 41496 - protein, 9 aa, Artificial Sequence
  Peptide Derived from Human Papillomavirus
DSDFMDIIR

SEQ ID NO: 41497 - protein, 11 aa, Artificial Sequence
  Peptide Derived from Human Papillomavirus
DSDFMDIIRLH

SEQ ID NO: 41498 - protein, 11 aa, Artificial Sequence
  Peptide Derived from Human Papillomavirus
DSSVVTSGAPR

SEQ ID NO: 41499 - protein, 9 aa, Artificial Sequence
  Peptide Derived from Human Papillomavirus
DTTLTFDPR

SEQ ID NO: 41500 - protein, 9 aa, Artificial Sequence
  Peptide Derived from Human Papillomavirus
EDNDLFDIY

SEQ ID NO: 41501 - protein, 8 aa, Artificial Sequence
  Peptide Derived from Human Papillomavirus
EGTTLADK

SEQ ID NO: 41502 - protein, 8 aa, Artificial Sequence
  Peptide Derived from Human Papillomavirus
FIPKKRKR

SEQ ID NO: 41503 - protein, 11 aa, Artificial Sequence
  Peptide Derived from Human Papillomavirus
FIPKKRKRVPY

SEQ ID NO: 41504 - protein, 11 aa, Artificial Sequence
  Peptide Derived from Human Papillomavirus
FLTRPSSLITY

SEQ ID NO: 41505 - protein, 8 aa, Artificial Sequence
  Peptide Derived from Human Papillomavirus
FMDIIRLH

SEQ ID NO: 41506 - protein, 9 aa, Artificial Sequence
  Peptide Derived from Human Papillomavirus
FMDIIRLHR

SEQ ID NO: 41507 - protein, 11 aa, Artificial Sequence
  Peptide Derived from Human Papillomavirus
FTRSGTQIGAR

SEQ ID NO: 41508 - protein, 10 aa, Artificial Sequence
  Peptide Derived from Human Papillomavirus
FVGTPTSGTH

SEQ ID NO: 41509 - protein, 8 aa, Artificial Sequence
  Peptide Derived from Human Papillomavirus
GARVHFYH

SEQ ID NO: 41510 - protein, 11 aa, Artificial Sequence
  Peptide Derived from Human Papillomavirus
GIGTGSGTGGR

SEQ ID NO: 41511 - protein, 8 aa, Artificial Sequence
  Peptide Derived from Human Papillomavirus
GIHGTHYY

SEQ ID NO: 41512 - protein, 10 aa, Artificial Sequence
  Peptide Derived from Human Papillomavirus
GSGTGGRTGY

SEQ ID NO: 41513 - protein, 10 aa, Artificial Sequence
  Peptide Derived from Human Papillomavirus
GTCPPDVVPK

SEQ ID NO: 41514 - protein, 8 aa, Artificial Sequence
  Peptide Derived from Human Papillomavirus
GTGGRTGY

SEQ ID NO: 41515 - protein, 9 aa, Artificial Sequence
  Peptide Derived from Human Papillomavirus
GTGSGTGGR

SEQ ID NO: 41516 - protein, 10 aa, Artificial Sequence
  Peptide Derived from Human Papillomavirus
GTHYYLWPLY

SEQ ID NO: 41517 - protein, 11 aa, Artificial Sequence
  Peptide Derived from Human Papillomavirus
GTHYYLWPLYY

SEQ ID NO: 41518 - protein, 8 aa, Artificial Sequence
  Peptide Derived from Human Papillomavirus
GTPTSGTH

SEQ ID NO: 41519 - protein, 10 aa, Artificial Sequence
  Peptide Derived from Human Papillomavirus
GTPTSGTHGY

SEQ ID NO: 41520 - protein, 9 aa, Artificial Sequence
  Peptide Derived from Human Papillomavirus
GTQIGARVH

SEQ ID NO: 41521 - protein, 11 aa, Artificial Sequence
  Peptide Derived from Human Papillomavirus
GTQIGARVHFY

SEQ ID NO: 41522 - protein, 11 aa, Artificial Sequence
  Peptide Derived from Human Papillomavirus
GTVRFSRLGQR

SEQ ID NO: 41523 - protein, 11 aa, Artificial Sequence
  Peptide Derived from Human Papillomavirus
HGTHYYLWPLY

SEQ ID NO: 41524 - protein, 8 aa, Artificial Sequence
  Peptide Derived from Human Papillomavirus
IGARVHFY

SEQ ID NO: 41525 - protein, 9 aa, Artificial Sequence
  Peptide Derived from Human Papillomavirus
IGARVHFYH

SEQ ID NO: 41526 - protein, 8 aa, Artificial Sequence
  Peptide Derived from Human Papillomavirus
IGIHGTHY

SEQ ID NO: 41527 - protein, 9 aa, Artificial Sequence
  Peptide Derived from Human Papillomavirus
IGIHGTHYY

SEQ ID NO: 41528 - protein, 10 aa, Artificial Sequence
  Peptide Derived from Human Papillomavirus
IGTGSGTGGR

SEQ ID NO: 41529 - protein, 10 aa, Artificial Sequence
  Peptide Derived from Human Papillomavirus
ISPIAPSPEY

SEQ ID NO: 41530 - protein, 10 aa, Artificial Sequence
  Peptide Derived from Human Papillomavirus
ISSTPLPTVR

SEQ ID NO: 41531 - protein, 11 aa, Artificial Sequence
  Peptide Derived from Human Papillomavirus
ISSTPLPTVRR

SEQ ID NO: 41532 - protein, 10 aa, Artificial Sequence
  Peptide Derived from Human Papillomavirus
KVEGTTLADK

SEQ ID NO: 41533 - protein, 10 aa, Artificial Sequence
  Peptide Derived from Human Papillomavirus
LGQRATMFTR

SEQ ID NO: 41534 - protein, 10 aa, Artificial Sequence
  Peptide Derived from Human Papillomavirus
LTRPSSLITY

SEQ ID NO: 41535 - protein, 9 aa, Artificial Sequence
  Peptide Derived from Human Papillomavirus
LTSRRGTVR

SEQ ID NO: 41536 - protein, 10 aa, Artificial Sequence
  Peptide Derived from Human Papillomavirus
LTSSWDVPVY

SEQ ID NO: 41537 - protein, 8 aa, Artificial Sequence
  Peptide Derived from Human Papillomavirus
MDIIRLHR

SEQ ID NO: 41538 - protein, 10 aa, Artificial Sequence
  Peptide Derived from Human Papillomavirus
MDPAVPVPSR

SEQ ID NO: 41539 - protein, 8 aa, Artificial Sequence
  Peptide Derived from Human Papillomavirus
MVSHRAAR

SEQ ID NO: 41540 - protein, 9 aa, Artificial Sequence
  Peptide Derived from Human Papillomavirus
MVSHRAARR

SEQ ID NO: 41541 - protein, 10 aa, Artificial Sequence
  Peptide Derived from Human Papillomavirus
MVSHRAARRK

SEQ ID NO: 41542 - protein, 11 aa, Artificial Sequence
  Peptide Derived from Human Papillomavirus
MVSHRAARRKR

SEQ ID NO: 41543 - protein, 10 aa, Artificial Sequence
  Peptide Derived from Human Papillomavirus
NTVVDVGPTR

SEQ ID NO: 41544 - protein, 11 aa, Artificial Sequence
  Peptide Derived from Human Papillomavirus
PALTSRRGTVR

SEQ ID NO: 41545 - protein, 10 aa, Artificial Sequence
  Peptide Derived from Human Papillomavirus
PASTQYIGIH

SEQ ID NO: 41546 - protein, 8 aa, Artificial Sequence
  Peptide Derived from Human Papillomavirus
PAVPVPSR

SEQ ID NO: 41547 - protein, 10 aa, Artificial Sequence
  Peptide Derived from Human Papillomavirus
PDSDFMDIIR

SEQ ID NO: 41548 - protein, 8 aa, Artificial Sequence
  Peptide Derived from Human Papillomavirus
PIAPSPEY

SEQ ID NO: 41549 - protein, 11 aa, Artificial Sequence
  Peptide Derived from Human Papillomavirus
PISSTPLPTVR

SEQ ID NO: 41550 - protein, 11 aa, Artificial Sequence
  Peptide Derived from Human Papillomavirus
PLTSSWDVPVY

SEQ ID NO: 41551 - protein, 8 aa, Artificial Sequence
  Peptide Derived from Human Papillomavirus
PLYYFIPK

SEQ ID NO: 41552 - protein, 9 aa, Artificial Sequence
  Peptide Derived from Human Papillomavirus
PLYYFIPKK

SEQ ID NO: 41553 - protein, 10 aa, Artificial Sequence
  Peptide Derived from Human Papillomavirus
PLYYFIPKKR

SEQ ID NO: 41554 - protein, 11 aa, Artificial Sequence
  Peptide Derived from Human Papillomavirus
PLYYFIPKKRK

SEQ ID NO: 41555 - protein, 9 aa, Artificial Sequence
  Peptide Derived from Human Papillomavirus
PTAPASTQY

SEQ ID NO: 41556 - protein, 9 aa, Artificial Sequence
  Peptide Derived from Human Papillomavirus
PTISSASSY

SEQ ID NO: 41557 - protein, 8 aa, Artificial Sequence
  Peptide Derived from Human Papillomavirus
PTSGTHGY

SEQ ID NO: 41558 - protein, 10 aa, Artificial Sequence
  Peptide Derived from Human Papillomavirus
PTVRRVAGPR

SEQ ID NO: 41559 - protein, 11 aa, Artificial Sequence
  Peptide Derived from Human Papillomavirus
PVDTTLTFDPR

SEQ ID NO: 41560 - protein, 9 aa, Artificial Sequence
  Peptide Derived from Human Papillomavirus
QIGARVHFY

SEQ ID NO: 41561 - protein, 10 aa, Artificial Sequence
  Peptide Derived from Human Papillomavirus
QIGARVHFYH

SEQ ID NO: 41562 - protein, 8 aa, Artificial Sequence
  Peptide Derived from Human Papillomavirus
RASVTDLY

SEQ ID NO: 41563 - protein, 9 aa, Artificial Sequence
  Peptide Derived from Human Papillomavirus
RASVTDLYK

SEQ ID NO: 41564 - protein, 8 aa, Artificial Sequence
  Peptide Derived from Human Papillomavirus
RFSRLGQR

SEQ ID NO: 41565 - protein, 8 aa, Artificial Sequence
  Peptide Derived from Human Papillomavirus
RGTVRFSR

SEQ ID NO: 41566 - protein, 11 aa, Artificial Sequence
  Peptide Derived from Human Papillomavirus
RLGQRATMFTR

SEQ ID NO: 41567 - protein, 10 aa, Artificial Sequence
  Peptide Derived from Human Papillomavirus
RLHRPALTSR

SEQ ID NO: 41568 - protein, 11 aa, Artificial Sequence
  Peptide Derived from Human Papillomavirus
RLHRPALTSRR

SEQ ID NO: 41569 - protein, 9 aa, Artificial Sequence
  Peptide Derived from Human Papillomavirus
RSGTQIGAR

SEQ ID NO: 41570 - protein, 11 aa, Artificial Sequence
  Peptide Derived from Human Papillomavirus
RSGTQIGARVH

SEQ ID NO: 41571 - protein, 10 aa, Artificial Sequence
  Peptide Derived from Human Papillomavirus
RSTTSFAFFK

SEQ ID NO: 41572 - protein, 11 aa, Artificial Sequence
  Peptide Derived from Human Papillomavirus
RSTTSFAFFKY

SEQ ID NO: 41573 - protein, 10 aa, Artificial Sequence
  Peptide Derived from Human Papillomavirus
RTGYIPLGGR

SEQ ID NO: 41574 - protein, 8 aa, Artificial Sequence
  Peptide Derived from Human Papillomavirus
RVAGPRLY

SEQ ID NO: 41575 - protein, 10 aa, Artificial Sequence
  Peptide Derived from Human Papillomavirus
RVAGPRLYSR

SEQ ID NO: 41576 - protein, 8 aa, Artificial Sequence
  Peptide Derived from Human Papillomavirus
SDFMDIIR

SEQ ID NO: 41577 - protein, 10 aa, Artificial Sequence
  Peptide Derived from Human Papillomavirus
SDFMDIIRLH

SEQ ID NO: 41578 - protein, 11 aa, Artificial Sequence
  Peptide Derived from Human Papillomavirus
SDFMDIIRLHR

SEQ ID NO: 41579 - protein, 11 aa, Artificial Sequence
  Peptide Derived from Human Papillomavirus
SGTCPPDVVPK

SEQ ID NO: 41580 - protein, 9 aa, Artificial Sequence
  Peptide Derived from Human Papillomavirus
SGTGGRTGY

SEQ ID NO: 41581 - protein, 8 aa, Artificial Sequence
  Peptide Derived from Human Papillomavirus
SGTQIGAR

SEQ ID NO: 41582 - protein, 10 aa, Artificial Sequence
  Peptide Derived from Human Papillomavirus
SGTQIGARVH

SEQ ID NO: 41583 - protein, 11 aa, Artificial Sequence
  Peptide Derived from Human Papillomavirus
SNTVVDVGPTR

SEQ ID NO: 41584 - protein, 9 aa, Artificial Sequence
  Peptide Derived from Human Papillomavirus
SSTPLPTVR

SEQ ID NO: 41585 - protein, 10 aa, Artificial Sequence
  Peptide Derived from Human Papillomavirus
SSTPLPTVRR

SEQ ID NO: 41586 - protein, 10 aa, Artificial Sequence
  Peptide Derived from Human Papillomavirus
SSVVTSGAPR

SEQ ID NO: 41587 - protein, 8 aa, Artificial Sequence
  Peptide Derived from Human Papillomavirus
SSWDVPVY

SEQ ID NO: 41588 - protein, 8 aa, Artificial Sequence
  Peptide Derived from Human Papillomavirus
STPLPTVR

SEQ ID NO: 41589 - protein, 9 aa, Artificial Sequence
  Peptide Derived from Human Papillomavirus
STPLPTVRR

SEQ ID NO: 41590 - protein, 8 aa, Artificial Sequence
  Peptide Derived from Human Papillomavirus
STQYIGIH

SEQ ID NO: 41591 - protein, 11 aa, Artificial Sequence
  Peptide Derived from Human Papillomavirus
STQYIGIHGTH

SEQ ID NO: 41592 - protein, 9 aa, Artificial Sequence
  Peptide Derived from Human Papillomavirus
STTSFAFFK

SEQ ID NO: 41593 - protein, 10 aa, Artificial Sequence
  Peptide Derived from Human Papillomavirus
STTSFAFFKY

SEQ ID NO: 41594 - protein, 10 aa, Artificial Sequence
  Peptide Derived from Human Papillomavirus
SVANPEFLTR

SEQ ID NO: 41595 - protein, 10 aa, Artificial Sequence
  Peptide Derived from Human Papillomavirus
SVTDLYKTCK

SEQ ID NO: 41596 - protein, 9 aa, Artificial Sequence
  Peptide Derived from Human Papillomavirus
SVVTSGAPR

SEQ ID NO: 41597 - protein, 8 aa, Artificial Sequence
  Peptide Derived from Human Papillomavirus
TAPASTQY

SEQ ID NO: 41598 - protein, 9 aa, Artificial Sequence
  Peptide Derived from Human Papillomavirus
TCPPDVVPK

SEQ ID NO: 41599 - protein, 8 aa, Artificial Sequence
  Peptide Derived from Human Papillomavirus
TDLYKTCK

SEQ ID NO: 41600 - protein, 8 aa, Artificial Sequence
  Peptide Derived from Human Papillomavirus
TGSGTGGR

SEQ ID NO: 41601 - protein, 11 aa, Artificial Sequence
  Peptide Derived from Human Papillomavirus
TGSGTGGRTGY

SEQ ID NO: 41602 - protein, 9 aa, Artificial Sequence
  Peptide Derived from Human Papillomavirus
TGYIPLGGR

SEQ ID NO: 41603 - protein, 8 aa, Artificial Sequence
  Peptide Derived from Human Papillomavirus
TISSASSY

SEQ ID NO: 41604 - protein, 8 aa, Artificial Sequence
  Peptide Derived from Human Papillomavirus
TSFAFFKY

SEQ ID NO: 41605 - protein, 8 aa, Artificial Sequence
  Peptide Derived from Human Papillomavirus
TSRRGTVR

SEQ ID NO: 41606 - protein, 11 aa, Artificial Sequence
  Peptide Derived from Human Papillomavirus
TSRRGTVRFSR

SEQ ID NO: 41607 - protein, 9 aa, Artificial Sequence
  Peptide Derived from Human Papillomavirus
TSSWDVPVY

SEQ ID NO: 41608 - protein, 8 aa, Artificial Sequence
  Peptide Derived from Human Papillomavirus
TTLTFDPR

SEQ ID NO: 41609 - protein, 8 aa, Artificial Sequence
  Peptide Derived from Human Papillomavirus
TTSFAFFK

SEQ ID NO: 41610 - protein, 9 aa, Artificial Sequence
  Peptide Derived from Human Papillomavirus
TTSFAFFKY

SEQ ID NO: 41611 - protein, 10 aa, Artificial Sequence
  Peptide Derived from Human Papillomavirus
TVRFSRLGQR

SEQ ID NO: 41612 - protein, 9 aa, Artificial Sequence
  Peptide Derived from Human Papillomavirus
TVRRVAGPR

SEQ ID NO: 41613 - protein, 11 aa, Artificial Sequence
  Peptide Derived from Human Papillomavirus
TVRRVAGPRLY

SEQ ID NO: 41614 - protein, 9 aa, Artificial Sequence
  Peptide Derived from Human Papillomavirus
TVVDVGPTR

SEQ ID NO: 41615 - protein, 9 aa, Artificial Sequence
  Peptide Derived from Human Papillomavirus
VAGPRLYSR

SEQ ID NO: 41616 - protein, 11 aa, Artificial Sequence
  Peptide Derived from Human Papillomavirus
VAGPRLYSRAY

SEQ ID NO: 41617 - protein, 9 aa, Artificial Sequence
  Peptide Derived from Human Papillomavirus
VANPEFLTR

SEQ ID NO: 41618 - protein, 10 aa, Artificial Sequence
  Peptide Derived from Human Papillomavirus
VDTTLTFDPR

SEQ ID NO: 41619 - protein, 11 aa, Artificial Sequence
  Peptide Derived from Human Papillomavirus
VFVGTPTSGTH

SEQ ID NO: 41620 - protein, 9 aa, Artificial Sequence
  Peptide Derived from Human Papillomavirus
VGTPTSGTH

SEQ ID NO: 41621 - protein, 11 aa, Artificial Sequence
  Peptide Derived from Human Papillomavirus
VGTPTSGTHGY

SEQ ID NO: 41622 - protein, 8 aa, Artificial Sequence
  Peptide Derived from Human Papillomavirus
VSHRAARR

SEQ ID NO: 41623 - protein, 9 aa, Artificial Sequence
  Peptide Derived from Human Papillomavirus
VSHRAARRK

SEQ ID NO: 41624 - protein, 10 aa, Artificial Sequence
  Peptide Derived from Human Papillomavirus
VSHRAARRKR

SEQ ID NO: 41625 - protein, 11 aa, Artificial Sequence
  Peptide Derived from Human Papillomavirus
VSPTAPASTQY

SEQ ID NO: 41626 - protein, 11 aa, Artificial Sequence
  Peptide Derived from Human Papillomavirus
VSVANPEFLTR

SEQ ID NO: 41627 - protein, 9 aa, Artificial Sequence
  Peptide Derived from Human Papillomavirus
VTDLYKTCK

SEQ ID NO: 41628 - protein, 8 aa, Artificial Sequence
  Peptide Derived from Human Papillomavirus
VVDVGPTR

SEQ ID NO: 41629 - protein, 8 aa, Artificial Sequence
  Peptide Derived from Human Papillomavirus
VVTSGAPR

SEQ ID NO: 41630 - protein, 8 aa, Artificial Sequence
  Peptide Derived from Human Papillomavirus
YFIPKKRK

SEQ ID NO: 41631 - protein, 9 aa, Artificial Sequence
  Peptide Derived from Human Papillomavirus
YFIPKKRKR

SEQ ID NO: 41632 - protein, 8 aa, Artificial Sequence
  Peptide Derived from Human Papillomavirus
YIGIHGTH

SEQ ID NO: 41633 - protein, 9 aa, Artificial Sequence
  Peptide Derived from Human Papillomavirus
YIGIHGTHY

SEQ ID NO: 41634 - protein, 10 aa, Artificial Sequence
  Peptide Derived from Human Papillomavirus
YIGIHGTHYY

SEQ ID NO: 41635 - protein, 11 aa, Artificial Sequence
  Peptide Derived from Human Papillomavirus
YLWPLYYFIPK

SEQ ID NO: 41636 - protein, 11 aa, Artificial Sequence
  Peptide Derived from Human Papillomavirus
YSPTISSASSY

SEQ ID NO: 41637 - protein, 8 aa, Artificial Sequence
  Peptide Derived from Human Papillomavirus
AAALYWYR

SEQ ID NO: 41638 - protein, 8 aa, Artificial Sequence
  Peptide Derived from Human Papillomavirus
AAMLGKFK

SEQ ID NO: 41639 - protein, 11 aa, Artificial Sequence
  Peptide Derived from Human Papillomavirus
AAMLGKFKELY

SEQ ID NO: 41640 - protein, 10 aa, Artificial Sequence
  Peptide Derived from Human Papillomavirus
AFLKSNSQAK

SEQ ID NO: 41641 - protein, 9 aa, Artificial Sequence
  Peptide Derived from Human Papillomavirus
AGKDDRWPY

SEQ ID NO: 41642 - protein, 11 aa, Artificial Sequence
  Peptide Derived from Human Papillomavirus
AGKDDRWPYLH

SEQ ID NO: 41643 - protein, 9 aa, Artificial Sequence
  Peptide Derived from Human Papillomavirus
AICIENNSK

SEQ ID NO: 41644 - protein, 11 aa, Artificial Sequence
  Peptide Derived from Human Papillomavirus
ALFHAQEAEEH

SEQ ID NO: 41645 - protein, 11 aa, Artificial Sequence
  Peptide Derived from Human Papillomavirus
ALKLFLKGVPK

SEQ ID NO: 41646 - protein, 10 aa, Artificial Sequence
  Peptide Derived from Human Papillomavirus
AMLGKFKELY

SEQ ID NO: 41647 - protein, 8 aa, Artificial Sequence
  Peptide Derived from Human Papillomavirus
ATTPCWHY

SEQ ID NO: 41648 - protein, 8 aa, Artificial Sequence
  Peptide Derived from Human Papillomavirus
AVQVLKRK

SEQ ID NO: 41649 - protein, 9 aa, Artificial Sequence
  Peptide Derived from Human Papillomavirus
AVQVLKRKY

SEQ ID NO: 41650 - protein, 11 aa, Artificial Sequence
  Peptide Derived from Human Papillomavirus
CAFLKSNSQAK

SEQ ID NO: 41651 - protein, 10 aa, Artificial Sequence
  Peptide Derived from Human Papillomavirus
CAKNRITIEK

SEQ ID NO: 41652 - protein, 11 aa, Artificial Sequence
  Peptide Derived from Human Papillomavirus
CDKVSDEGDWR

SEQ ID NO: 41653 - protein, 8 aa, Artificial Sequence
  Peptide Derived from Human Papillomavirus
CGTMCRHY

SEQ ID NO: 41654 - protein, 9 aa, Artificial Sequence
  Peptide Derived from Human Papillomavirus
CGTMCRHYK

SEQ ID NO: 41655 - protein, 10 aa, Artificial Sequence
  Peptide Derived from Human Papillomavirus
CGTMCRHYKR

SEQ ID NO: 41656 - protein, 10 aa, Artificial Sequence
  Peptide Derived from Human Papillomavirus
CIENNSKTAK

SEQ ID NO: 41657 - protein, 11 aa, Artificial Sequence
  Peptide Derived from Human Papillomavirus
CIENNSKTAKR

SEQ ID NO: 41658 - protein, 9 aa, Artificial Sequence
  Peptide Derived from Human Papillomavirus
CIISYANSK

SEQ ID NO: 41659 - protein, 11 aa, Artificial Sequence
  Peptide Derived from Human Papillomavirus
CIISYANSKSH

SEQ ID NO: 41660 - protein, 8 aa, Artificial Sequence
  Peptide Derived from Human Papillomavirus
CMLIQPPK

SEQ ID NO: 41661 - protein, 10 aa, Artificial Sequence
  Peptide Derived from Human Papillomavirus
CMLIQPPKLR

SEQ ID NO: 41662 - protein, 8 aa, Artificial Sequence
  Peptide Derived from Human Papillomavirus
CNGSDGTH

SEQ ID NO: 41663 - protein, 11 aa, Artificial Sequence
  Peptide Derived from Human Papillomavirus
CNGSDGTHSER

SEQ ID NO: 41664 - protein, 9 aa, Artificial Sequence
  Peptide Derived from Human Papillomavirus
CVDYNISPR

SEQ ID NO: 41665 - protein, 11 aa, Artificial Sequence
  Peptide Derived from Human Papillomavirus
CVDYNISPRLK

SEQ ID NO: 41666 - protein, 8 aa, Artificial Sequence
  Peptide Derived from Human Papillomavirus
CVSGQNIR

SEQ ID NO: 41667 - protein, 8 aa, Artificial Sequence
  Peptide Derived from Human Papillomavirus
DATTPCWH

SEQ ID NO: 41668 - protein, 9 aa, Artificial Sequence
  Peptide Derived from Human Papillomavirus
DATTPCWHY

SEQ ID NO: 41669 - protein, 8 aa, Artificial Sequence
  Peptide Derived from Human Papillomavirus
DCGTMCRH

SEQ ID NO: 41670 - protein, 9 aa, Artificial Sequence
  Peptide Derived from Human Papillomavirus
DCGTMCRHY

SEQ ID NO: 41671 - protein, 10 aa, Artificial Sequence
  Peptide Derived from Human Papillomavirus
DCGTMCRHYK

SEQ ID NO: 41672 - protein, 11 aa, Artificial Sequence
  Peptide Derived from Human Papillomavirus
DCGTMCRHYKR

SEQ ID NO: 41673 - protein, 9 aa, Artificial Sequence
  Peptide Derived from Human Papillomavirus
DDATTPCWH

SEQ ID NO: 41674 - protein, 10 aa, Artificial Sequence
  Peptide Derived from Human Papillomavirus
DDATTPCWHY

SEQ ID NO: 41675 - protein, 8 aa, Artificial Sequence
  Peptide Derived from Human Papillomavirus
DDRWPYLH

SEQ ID NO: 41676 - protein, 10 aa, Artificial Sequence
  Peptide Derived from Human Papillomavirus
DDRWPYLHSR

SEQ ID NO: 41677 - protein, 8 aa, Artificial Sequence
  Peptide Derived from Human Papillomavirus
DDSEIAYK

SEQ ID NO: 41678 - protein, 9 aa, Artificial Sequence
  Peptide Derived from Human Papillomavirus
DDSEIAYKY

SEQ ID NO: 41679 - protein, 9 aa, Artificial Sequence
  Peptide Derived from Human Papillomavirus
DFIDNCNVY

SEQ ID NO: 41680 - protein, 9 aa, Artificial Sequence
  Peptide Derived from Human Papillomavirus
DGDSFSTFK

SEQ ID NO: 41681 - protein, 10 aa, Artificial Sequence
  Peptide Derived from Human Papillomavirus
DGNPVSIDVK

SEQ ID NO: 41682 - protein, 11 aa, Artificial Sequence
  Peptide Derived from Human Papillomavirus
DGNPVSIDVKH

SEQ ID NO: 41683 - protein, 8 aa, Artificial Sequence
  Peptide Derived from Human Papillomavirus
DISSCVDY

SEQ ID NO: 41684 - protein, 8 aa, Artificial Sequence
  Peptide Derived from Human Papillomavirus
DIVKFLRY

SEQ ID NO: 41685 - protein, 10 aa, Artificial Sequence
  Peptide Derived from Human Papillomavirus
DLSQMVQWAY

SEQ ID NO: 41686 - protein, 11 aa, Artificial Sequence
  Peptide Derived from Human Papillomavirus
DSDSNACAFLK

SEQ ID NO: 41687 - protein, 8 aa, Artificial Sequence
  Peptide Derived from Human Papillomavirus
DSEIAYKY

SEQ ID NO: 41688 - protein, 9 aa, Artificial Sequence
  Peptide Derived from Human Papillomavirus
DSNACAFLK

SEQ ID NO: 41689 - protein, 11 aa, Artificial Sequence
  Peptide Derived from Human Papillomavirus
DVKHKALMQLK

SEQ ID NO: 41690 - protein, 10 aa, Artificial Sequence
  Peptide Derived from Human Papillomavirus
DVMDDSEIAY

SEQ ID NO: 41691 - protein, 11 aa, Artificial Sequence
  Peptide Derived from Human Papillomavirus
DVMDDSEIAYK

SEQ ID NO: 41692 - protein, 10 aa, Artificial Sequence
  Peptide Derived from Human Papillomavirus
EAETAQALFH

SEQ ID NO: 41693 - protein, 8 aa, Artificial Sequence
  Peptide Derived from Human Papillomavirus
EAVQVLKR

SEQ ID NO: 41694 - protein, 9 aa, Artificial Sequence
  Peptide Derived from Human Papillomavirus
EAVQVLKRK

SEQ ID NO: 41695 - protein, 10 aa, Artificial Sequence
  Peptide Derived from Human Papillomavirus
EAVQVLKRKY

SEQ ID NO: 41696 - protein, 10 aa, Artificial Sequence
  Peptide Derived from Human Papillomavirus
EFVSFLSALK

SEQ ID NO: 41697 - protein, 9 aa, Artificial Sequence
  Peptide Derived from Human Papillomavirus
EGDWRDIVK

SEQ ID NO: 41698 - protein, 10 aa, Artificial Sequence
  Peptide Derived from Human Papillomavirus
EGFKTLLQPY

SEQ ID NO: 41699 - protein, 10 aa, Artificial Sequence
  Peptide Derived from Human Papillomavirus
EGTGCNGWFY

SEQ ID NO: 41700 - protein, 10 aa, Artificial Sequence
  Peptide Derived from Human Papillomavirus
ELIRPFQSNK

SEQ ID NO: 41701 - protein, 8 aa, Artificial Sequence
  Peptide Derived from Human Papillomavirus
ELSDKNWK

SEQ ID NO: 41702 - protein, 11 aa, Artificial Sequence
  Peptide Derived from Human Papillomavirus
ENDGDSFSTFK

SEQ ID NO: 41703 - protein, 8 aa, Artificial Sequence
  Peptide Derived from Human Papillomavirus
ENNSKTAK

SEQ ID NO: 41704 - protein, 9 aa, Artificial Sequence
  Peptide Derived from Human Papillomavirus
ENNSKTAKR

SEQ ID NO: 41705 - protein, 10 aa, Artificial Sequence
  Peptide Derived from Human Papillomavirus
ENNSKTAKRR

SEQ ID NO: 41706 - protein, 8 aa, Artificial Sequence
  Peptide Derived from Human Papillomavirus
ETAQALFH

SEQ ID NO: 41707 - protein, 8 aa, Artificial Sequence
  Peptide Derived from Human Papillomavirus
ETPEWIER

SEQ ID NO: 41708 - protein, 9 aa, Artificial Sequence
  Peptide Derived from Human Papillomavirus
FDKNGNPVY

SEQ ID NO: 41709 - protein, 11 aa, Artificial Sequence
  Peptide Derived from Human Papillomavirus
FDLSQMVQWAY

SEQ ID NO: 41710 - protein, 8 aa, Artificial Sequence
  Peptide Derived from Human Papillomavirus
FFSRTWCR

SEQ ID NO: 41711 - protein, 8 aa, Artificial Sequence
  Peptide Derived from Human Papillomavirus
FIDNCNVY

SEQ ID NO: 41712 - protein, 8 aa, Artificial Sequence
  Peptide Derived from Human Papillomavirus
FLKGVPKK

SEQ ID NO: 41713 - protein, 9 aa, Artificial Sequence
  Peptide Derived from Human Papillomavirus
FLKSNSQAK

SEQ ID NO: 41714 - protein, 9 aa, Artificial Sequence
  Peptide Derived from Human Papillomavirus
FLQGCIISY

SEQ ID NO: 41715 - protein, 10 aa, Artificial Sequence
  Peptide Derived from Human Papillomavirus
FLSALKLFLK

SEQ ID NO: 41716 - protein, 11 aa, Artificial Sequence
  Peptide Derived from Human Papillomavirus
FSRTWCRLNLH

SEQ ID NO: 41717 - protein, 11 aa, Artificial Sequence
  Peptide Derived from Human Papillomavirus
FTFPNPFPFDK

SEQ ID NO: 41718 - protein, 9 aa, Artificial Sequence
  Peptide Derived from Human Papillomavirus
FVSFLSALK

SEQ ID NO: 41719 - protein, 9 aa, Artificial Sequence
  Peptide Derived from Human Papillomavirus
GAPNTGKSY

SEQ ID NO: 41720 - protein, 10 aa, Artificial Sequence
  Peptide Derived from Human Papillomavirus
GCIISYANSK

SEQ ID NO: 41721 - protein, 8 aa, Artificial Sequence
  Peptide Derived from Human Papillomavirus
GDSFSTFK

SEQ ID NO: 41722 - protein, 8 aa, Artificial Sequence
  Peptide Derived from Human Papillomavirus
GDWRDIVK

SEQ ID NO: 41723 - protein, 11 aa, Artificial Sequence
  Peptide Derived from Human Papillomavirus
GDWRDIVKFLR

SEQ ID NO: 41724 - protein, 9 aa, Artificial Sequence
  Peptide Derived from Human Papillomavirus
GFKTLLQPY

SEQ ID NO: 41725 - protein, 9 aa, Artificial Sequence
  Peptide Derived from Human Papillomavirus
GMSNISDVY

SEQ ID NO: 41726 - protein, 9 aa, Artificial Sequence
  Peptide Derived from Human Papillomavirus
GMVMLMLVR

SEQ ID NO: 41727 - protein, 11 aa, Artificial Sequence
  Peptide Derived from Human Papillomavirus
GMVMLMLVRFK

SEQ ID NO: 41728 - protein, 9 aa, Artificial Sequence
  Peptide Derived from Human Papillomavirus
GNPVSIDVK

SEQ ID NO: 41729 - protein, 10 aa, Artificial Sequence
  Peptide Derived from Human Papillomavirus
GNPVSIDVKH

SEQ ID NO: 41730 - protein, 11 aa, Artificial Sequence
  Peptide Derived from Human Papillomavirus
GNPVSIDVKHK

SEQ ID NO: 41731 - protein, 10 aa, Artificial Sequence
  Peptide Derived from Human Papillomavirus
GNPVYELSDK

SEQ ID NO: 41732 - protein, 9 aa, Artificial Sequence
  Peptide Derived from Human Papillomavirus
GSDGTHSER

SEQ ID NO: 41733 - protein, 9 aa, Artificial Sequence
  Peptide Derived from Human Papillomavirus
GTGCNGWFY

SEQ ID NO: 41734 - protein, 8 aa, Artificial Sequence
  Peptide Derived from Human Papillomavirus
GTMCRHYK

SEQ ID NO: 41735 - protein, 9 aa, Artificial Sequence
  Peptide Derived from Human Papillomavirus
GTMCRHYKR

SEQ ID NO: 41736 - protein, 8 aa, Artificial Sequence
  Peptide Derived from Human Papillomavirus
GTVAEGFK

SEQ ID NO: 41737 - protein, 11 aa, Artificial Sequence
  Peptide Derived from Human Papillomavirus
GVPKKNCILIH

SEQ ID NO: 41738 - protein, 9 aa, Artificial Sequence
  Peptide Derived from Human Papillomavirus
GVSFMELIR

SEQ ID NO: 41739 - protein, 11 aa, Artificial Sequence
  Peptide Derived from Human Papillomavirus
GVTGTVAEGFK

SEQ ID NO: 41740 - protein, 9 aa, Artificial Sequence
  Peptide Derived from Human Papillomavirus
HAEAVQVLK

SEQ ID NO: 41741 - protein, 10 aa, Artificial Sequence
  Peptide Derived from Human Papillomavirus
HAEAVQVLKR

SEQ ID NO: 41742 - protein, 11 aa, Artificial Sequence
  Peptide Derived from Human Papillomavirus
HAEAVQVLKRK

SEQ ID NO: 41743 - protein, 8 aa, Artificial Sequence
  Peptide Derived from Human Papillomavirus
HAQEAEEH

SEQ ID NO: 41744 - protein, 11 aa, Artificial Sequence
  Peptide Derived from Human Papillomavirus
HFWLQPLADAK

SEQ ID NO: 41745 - protein, 8 aa, Artificial Sequence
  Peptide Derived from Human Papillomavirus
HGAPNTGK

SEQ ID NO: 41746 - protein, 10 aa, Artificial Sequence
  Peptide Derived from Human Papillomavirus
HGAPNTGKSY

SEQ ID NO: 41747 - protein, 11 aa, Artificial Sequence
  Peptide Derived from Human Papillomavirus
HSERENETPTR

SEQ ID NO: 41748 - protein, 8 aa, Artificial Sequence
  Peptide Derived from Human Papillomavirus
ICIENNSK

SEQ ID NO: 41749 - protein, 11 aa, Artificial Sequence
  Peptide Derived from Human Papillomavirus
ICIENNSKTAK

SEQ ID NO: 41750 - protein, 8 aa, Artificial Sequence
  Peptide Derived from Human Papillomavirus
IISYANSK

SEQ ID NO: 41751 - protein, 10 aa, Artificial Sequence
  Peptide Derived from Human Papillomavirus
IISYANSKSH

SEQ ID NO: 41752 - protein, 11 aa, Artificial Sequence
  Peptide Derived from Human Papillomavirus
ILIHGAPNTGK

SEQ ID NO: 41753 - protein, 11 aa, Artificial Sequence
  Peptide Derived from Human Papillomavirus
ILQVLKTSNGK

SEQ ID NO: 41754 - protein, 8 aa, Artificial Sequence
  Peptide Derived from Human Papillomavirus
INAGKDDR

SEQ ID NO: 41755 - protein, 11 aa, Artificial Sequence
  Peptide Derived from Human Papillomavirus
INAGKDDRWPY

SEQ ID NO: 41756 - protein, 11 aa, Artificial Sequence
  Peptide Derived from Human Papillomavirus
ISFLQGCIISY

SEQ ID NO: 41757 - protein, 9 aa, Artificial Sequence
  Peptide Derived from Human Papillomavirus
ISYANSKSH

SEQ ID NO: 41758 - protein, 9 aa, Artificial Sequence
  Peptide Derived from Human Papillomavirus
ITIEKLLEK

SEQ ID NO: 41759 - protein, 9 aa, Artificial Sequence
  Peptide Derived from Human Papillomavirus
ITSNINAGK

SEQ ID NO: 41760 - protein, 10 aa, Artificial Sequence
  Peptide Derived from Human Papillomavirus
IVKDCGTMCR

SEQ ID NO: 41761 - protein, 11 aa, Artificial Sequence
  Peptide Derived from Human Papillomavirus
IVKDCGTMCRH

SEQ ID NO: 41762 - protein, 9 aa, Artificial Sequence
  Peptide Derived from Human Papillomavirus
KAAMLGKFK

SEQ ID NO: 41763 - protein, 10 aa, Artificial Sequence
  Peptide Derived from Human Papillomavirus
KAICIENNSK

SEQ ID NO: 41764 - protein, 11 aa, Artificial Sequence
  Peptide Derived from Human Papillomavirus
KCAKNRITIEK

SEQ ID NO: 41765 - protein, 9 aa, Artificial Sequence
  Peptide Derived from Human Papillomavirus
KCVSGQNIR

SEQ ID NO: 41766 - protein, 8 aa, Artificial Sequence
  Peptide Derived from Human Papillomavirus
KDCGTMCR

SEQ ID NO: 41767 - protein, 9 aa, Artificial Sequence
  Peptide Derived from Human Papillomavirus
KDCGTMCRH

SEQ ID NO: 41768 - protein, 10 aa, Artificial Sequence
  Peptide Derived from Human Papillomavirus
KDCGTMCRHY

SEQ ID NO: 41769 - protein, 11 aa, Artificial Sequence
  Peptide Derived from Human Papillomavirus
KDCGTMCRHYK

SEQ ID NO: 41770 - protein, 9 aa, Artificial Sequence
  Peptide Derived from Human Papillomavirus
KDDRWPYLH

SEQ ID NO: 41771 - protein, 11 aa, Artificial Sequence
  Peptide Derived from Human Papillomavirus
KDDRWPYLHSR

SEQ ID NO: 41772 - protein, 11 aa, Artificial Sequence
  Peptide Derived from Human Papillomavirus
KIVKDCGTMCR

SEQ ID NO: 41773 - protein, 9 aa, Artificial Sequence
  Peptide Derived from Human Papillomavirus
KLFLKGVPK

SEQ ID NO: 41774 - protein, 10 aa, Artificial Sequence
  Peptide Derived from Human Papillomavirus
KLFLKGVPKK

SEQ ID NO: 41775 - protein, 10 aa, Artificial Sequence
  Peptide Derived from Human Papillomavirus
KLRSTAAALY

SEQ ID NO: 41776 - protein, 8 aa, Artificial Sequence
  Peptide Derived from Human Papillomavirus
KNRITIEK

SEQ ID NO: 41777 - protein, 9 aa, Artificial Sequence
  Peptide Derived from Human Papillomavirus
KNWKSFFSR

SEQ ID NO: 41778 - protein, 10 aa, Artificial Sequence
  Peptide Derived from Human Papillomavirus
KSFFSRTWCR

SEQ ID NO: 41779 - protein, 10 aa, Artificial Sequence
  Peptide Derived from Human Papillomavirus
KSNSQAKIVK

SEQ ID NO: 41780 - protein, 10 aa, Artificial Sequence
  Peptide Derived from Human Papillomavirus
KTLLQPYCLY

SEQ ID NO: 41781 - protein, 9 aa, Artificial Sequence
  Peptide Derived from Human Papillomavirus
KVSDEGDWR

SEQ ID NO: 41782 - protein, 10 aa, Artificial Sequence
  Peptide Derived from Human Papillomavirus
LDDATTPCWH

SEQ ID NO: 41783 - protein, 11 aa, Artificial Sequence
  Peptide Derived from Human Papillomavirus
LDDATTPCWHY

SEQ ID NO: 41784 - protein, 11 aa, Artificial Sequence
  Peptide Derived from Human Papillomavirus
LDGNPVSIDVK

SEQ ID NO: 41785 - protein, 9 aa, Artificial Sequence
  Peptide Derived from Human Papillomavirus
LFELPDSGY

SEQ ID NO: 41786 - protein, 10 aa, Artificial Sequence
  Peptide Derived from Human Papillomavirus
LFHAQEAEEH

SEQ ID NO: 41787 - protein, 8 aa, Artificial Sequence
  Peptide Derived from Human Papillomavirus
LFLKGVPK

SEQ ID NO: 41788 - protein, 9 aa, Artificial Sequence
  Peptide Derived from Human Papillomavirus
LFLKGVPKK

SEQ ID NO: 41789 - protein, 8 aa, Artificial Sequence
  Peptide Derived from Human Papillomavirus
LGKFKELY

SEQ ID NO: 41790 - protein, 10 aa, Artificial Sequence
  Peptide Derived from Human Papillomavirus
LIHGAPNTGK

SEQ ID NO: 41791 - protein, 8 aa, Artificial Sequence
  Peptide Derived from Human Papillomavirus
LIQPPKLR

SEQ ID NO: 41792 - protein, 9 aa, Artificial Sequence
  Peptide Derived from Human Papillomavirus
LIRPFQSNK

SEQ ID NO: 41793 - protein, 10 aa, Artificial Sequence
  Peptide Derived from Human Papillomavirus
LITSNINAGK

SEQ ID NO: 41794 - protein, 11 aa, Artificial Sequence
  Peptide Derived from Human Papillomavirus
LLITSNINAGK

SEQ ID NO: 41795 - protein, 8 aa, Artificial Sequence
  Peptide Derived from Human Papillomavirus
LLQPYCLY

SEQ ID NO: 41796 - protein, 10 aa, Artificial Sequence
  Peptide Derived from Human Papillomavirus
LLQPYCLYCH

SEQ ID NO: 41797 - protein, 10 aa, Artificial Sequence
  Peptide Derived from Human Papillomavirus
LMLVRFKCAK

SEQ ID NO: 41798 - protein, 9 aa, Artificial Sequence
  Peptide Derived from Human Papillomavirus
LNLHEEEDK

SEQ ID NO: 41799 - protein, 9 aa, Artificial Sequence
  Peptide Derived from Human Papillomavirus
LSALKLFLK

SEQ ID NO: 41800 - protein, 10 aa, Artificial Sequence
  Peptide Derived from Human Papillomavirus
LSCNGSDGTH

SEQ ID NO: 41801 - protein, 10 aa, Artificial Sequence
  Peptide Derived from Human Papillomavirus
LSDISSCVDY

SEQ ID NO: 41802 - protein, 9 aa, Artificial Sequence
  Peptide Derived from Human Papillomavirus
LSQMVQWAY

SEQ ID NO: 41803 - protein, 8 aa, Artificial Sequence
  Peptide Derived from Human Papillomavirus
LVRFKCAK

SEQ ID NO: 41804 - protein, 10 aa, Artificial Sequence
  Peptide Derived from Human Papillomavirus
LVRFKCAKNR

SEQ ID NO: 41805 - protein, 10 aa, Artificial Sequence
  Peptide Derived from Human Papillomavirus
MCRHYKRAEK

SEQ ID NO: 41806 - protein, 11 aa, Artificial Sequence
  Peptide Derived from Human Papillomavirus
MCRHYKRAEKR

SEQ ID NO: 41807 - protein, 8 aa, Artificial Sequence
  Peptide Derived from Human Papillomavirus
MDDSEIAY

SEQ ID NO: 41808 - protein, 9 aa, Artificial Sequence
  Peptide Derived from Human Papillomavirus
MDDSEIAYK

SEQ ID NO: 41809 - protein, 10 aa, Artificial Sequence
  Peptide Derived from Human Papillomavirus
MDDSEIAYKY

SEQ ID NO: 41810 - protein, 8 aa, Artificial Sequence
  Peptide Derived from Human Papillomavirus
MGQWIKSR

SEQ ID NO: 41811 - protein, 11 aa, Artificial Sequence
  Peptide Derived from Human Papillomavirus
MGQWIKSRCDK

SEQ ID NO: 41812 - protein, 11 aa, Artificial Sequence
  Peptide Derived from Human Papillomavirus
MLDDATTPCWH

SEQ ID NO: 41813 - protein, 9 aa, Artificial Sequence
  Peptide Derived from Human Papillomavirus
MLGKFKELY

SEQ ID NO: 41814 - protein, 9 aa, Artificial Sequence
  Peptide Derived from Human Papillomavirus
MLIQPPKLR

SEQ ID NO: 41815 - protein, 8 aa, Artificial Sequence
  Peptide Derived from Human Papillomavirus
MLMLVRFK

SEQ ID NO: 41816 - protein, 11 aa, Artificial Sequence
  Peptide Derived from Human Papillomavirus
MLMLVRFKCAK

SEQ ID NO: 41817 - protein, 9 aa, Artificial Sequence
  Peptide Derived from Human Papillomavirus
MLVRFKCAK

SEQ ID NO: 41818 - protein, 11 aa, Artificial Sequence
  Peptide Derived from Human Papillomavirus
MLVRFKCAKNR

SEQ ID NO: 41819 - protein, 8 aa, Artificial Sequence
  Peptide Derived from Human Papillomavirus
MSMGQWIK

SEQ ID NO: 41820 - protein, 10 aa, Artificial Sequence
  Peptide Derived from Human Papillomavirus
MSMGQWIKSR

SEQ ID NO: 41821 - protein, 8 aa, Artificial Sequence
  Peptide Derived from Human Papillomavirus
MSNISDVY

SEQ ID NO: 41822 - protein, 11 aa, Artificial Sequence
  Peptide Derived from Human Papillomavirus
MVDFIDNCNVY

SEQ ID NO: 41823 - protein, 8 aa, Artificial Sequence
  Peptide Derived from Human Papillomavirus
MVMLMLVR

SEQ ID NO: 41824 - protein, 10 aa, Artificial Sequence
  Peptide Derived from Human Papillomavirus
MVMLMLVRFK

SEQ ID NO: 41825 - protein, 10 aa, Artificial Sequence
  Peptide Derived from Human Papillomavirus
NAGKDDRWPY

SEQ ID NO: 41826 - protein, 9 aa, Artificial Sequence
  Peptide Derived from Human Papillomavirus
NCMLIQPPK

SEQ ID NO: 41827 - protein, 11 aa, Artificial Sequence
  Peptide Derived from Human Papillomavirus
NCMLIQPPKLR

SEQ ID NO: 41828 - protein, 10 aa, Artificial Sequence
  Peptide Derived from Human Papillomavirus
NDGDSFSTFK

SEQ ID NO: 41829 - protein, 11 aa, Artificial Sequence
  Peptide Derived from Human Papillomavirus
NDVMDDSEIAY

SEQ ID NO: 41830 - protein, 9 aa, Artificial Sequence
  Peptide Derived from Human Papillomavirus
NGKAAMLGK

SEQ ID NO: 41831 - protein, 11 aa, Artificial Sequence
  Peptide Derived from Human Papillomavirus
NGKAAMLGKFK

SEQ ID NO: 41832 - protein, 11 aa, Artificial Sequence
  Peptide Derived from Human Papillomavirus
NGNPVYELSDK

SEQ ID NO: 41833 - protein, 10 aa, Artificial Sequence
  Peptide Derived from Human Papillomavirus
NGSDGTHSER

SEQ ID NO: 41834 - protein, 9 aa, Artificial Sequence
  Peptide Derived from Human Papillomavirus
NINAGKDDR

SEQ ID NO: 41835 - protein, 8 aa, Artificial Sequence
  Peptide Derived from Human Papillomavirus
NLHEEEDK

SEQ ID NO: 41836 - protein, 8 aa, Artificial Sequence
  Peptide Derived from Human Papillomavirus
NNSKTAKR

SEQ ID NO: 41837 - protein, 9 aa, Artificial Sequence
  Peptide Derived from Human Papillomavirus
NNSKTAKRR

SEQ ID NO: 41838 - protein, 8 aa, Artificial Sequence
  Peptide Derived from Human Papillomavirus
NSKTAKRR

SEQ ID NO: 41839 - protein, 8 aa, Artificial Sequence
  Peptide Derived from Human Papillomavirus
NSQAKIVK

SEQ ID NO: 41840 - protein, 9 aa, Artificial Sequence
  Peptide Derived from Human Papillomavirus
PCWHYIDNY

SEQ ID NO: 41841 - protein, 11 aa, Artificial Sequence
  Peptide Derived from Human Papillomavirus
PCWHYIDNYLR

SEQ ID NO: 41842 - protein, 10 aa, Artificial Sequence
  Peptide Derived from Human Papillomavirus
PFDKNGNPVY

SEQ ID NO: 41843 - protein, 11 aa, Artificial Sequence
  Peptide Derived from Human Papillomavirus
PLSDISSCVDY

SEQ ID NO: 41844 - protein, 8 aa, Artificial Sequence
  Peptide Derived from Human Papillomavirus
PNPFPFDK

SEQ ID NO: 41845 - protein, 10 aa, Artificial Sequence
  Peptide Derived from Human Papillomavirus
PTRNILQVLK

SEQ ID NO: 41846 - protein, 8 aa, Artificial Sequence
  Peptide Derived from Human Papillomavirus
PVSIDVKH

SEQ ID NO: 41847 - protein, 9 aa, Artificial Sequence
  Peptide Derived from Human Papillomavirus
PVSIDVKHK

SEQ ID NO: 41848 - protein, 8 aa, Artificial Sequence
  Peptide Derived from Human Papillomavirus
PVYELSDK

SEQ ID NO: 41849 - protein, 11 aa, Artificial Sequence
  Peptide Derived from Human Papillomavirus
PVYELSDKNWK

SEQ ID NO: 41850 - protein, 11 aa, Artificial Sequence
  Peptide Derived from Human Papillomavirus
QGCIISYANSK

SEQ ID NO: 41851 - protein, 9 aa, Artificial Sequence
  Peptide Derived from Human Papillomavirus
QMSMGQWIK

SEQ ID NO: 41852 - protein, 11 aa, Artificial Sequence
  Peptide Derived from Human Papillomavirus
QMSMGQWIKSR

SEQ ID NO: 41853 - protein, 9 aa, Artificial Sequence
  Peptide Derived from Human Papillomavirus
QVLKTSNGK

SEQ ID NO: 41854 - protein, 8 aa, Artificial Sequence
  Peptide Derived from Human Papillomavirus
RDIVKFLR

SEQ ID NO: 41855 - protein, 9 aa, Artificial Sequence
  Peptide Derived from Human Papillomavirus
RDIVKFLRY

SEQ ID NO: 41856 - protein, 8 aa, Artificial Sequence
  Peptide Derived from Human Papillomavirus
RFKCAKNR

SEQ ID NO: 41857 - protein, 10 aa, Artificial Sequence
  Peptide Derived from Human Papillomavirus
RITIEKLLEK

SEQ ID NO: 41858 - protein, 10 aa, Artificial Sequence
  Peptide Derived from Human Papillomavirus
RLFELPDSGY

SEQ ID NO: 41859 - protein, 10 aa, Artificial Sequence
  Peptide Derived from Human Papillomavirus
RLNLHEEEDK

SEQ ID NO: 41860 - protein, 8 aa, Artificial Sequence
  Peptide Derived from Human Papillomavirus
RNILQVLK

SEQ ID NO: 41861 - protein, 8 aa, Artificial Sequence
  Peptide Derived from Human Papillomavirus
RSTAAALY

SEQ ID NO: 41862 - protein, 10 aa, Artificial Sequence
  Peptide Derived from Human Papillomavirus
RSTAAALYWY

SEQ ID NO: 41863 - protein, 11 aa, Artificial Sequence
  Peptide Derived from Human Papillomavirus
RSTAAALYWYR

SEQ ID NO: 41864 - protein, 11 aa, Artificial Sequence
  Peptide Derived from Human Papillomavirus
RTGMSNISDVY

SEQ ID NO: 41865 - protein, 9 aa, Artificial Sequence
  Peptide Derived from Human Papillomavirus
RTWCRLNLH

SEQ ID NO: 41866 - protein, 8 aa, Artificial Sequence
  Peptide Derived from Human Papillomavirus
SALKLFLK

SEQ ID NO: 41867 - protein, 9 aa, Artificial Sequence
  Peptide Derived from Human Papillomavirus
SCNGSDGTH

SEQ ID NO: 41868 - protein, 10 aa, Artificial Sequence
  Peptide Derived from Human Papillomavirus
SCVDYNISPR

SEQ ID NO: 41869 - protein, 11 aa, Artificial Sequence
  Peptide Derived from Human Papillomavirus
SDEGDWRDIVK

SEQ ID NO: 41870 - protein, 8 aa, Artificial Sequence
  Peptide Derived from Human Papillomavirus
SDGTHSER

SEQ ID NO: 41871 - protein, 9 aa, Artificial Sequence
  Peptide Derived from Human Papillomavirus
SDISSCVDY

SEQ ID NO: 41872 - protein, 11 aa, Artificial Sequence
  Peptide Derived from Human Papillomavirus
SDKNWKSFFSR

SEQ ID NO: 41873 - protein, 10 aa, Artificial Sequence
  Peptide Derived from Human Papillomavirus
SDSNACAFLK

SEQ ID NO: 41874 - protein, 9 aa, Artificial Sequence
  Peptide Derived from Human Papillomavirus
SFFSRTWCR

SEQ ID NO: 41875 - protein, 10 aa, Artificial Sequence
  Peptide Derived from Human Papillomavirus
SFLQGCIISY

SEQ ID NO: 41876 - protein, 11 aa, Artificial Sequence
  Peptide Derived from Human Papillomavirus
SFLSALKLFLK

SEQ ID NO: 41877 - protein, 9 aa, Artificial Sequence
  Peptide Derived from Human Papillomavirus
SMGQWIKSR

SEQ ID NO: 41878 - protein, 8 aa, Artificial Sequence
  Peptide Derived from Human Papillomavirus
SNACAFLK

SEQ ID NO: 41879 - protein, 10 aa, Artificial Sequence
  Peptide Derived from Human Papillomavirus
SNGKAAMLGK

SEQ ID NO: 41880 - protein, 10 aa, Artificial Sequence
  Peptide Derived from Human Papillomavirus
SNINAGKDDR

SEQ ID NO: 41881 - protein, 9 aa, Artificial Sequence
  Peptide Derived from Human Papillomavirus
SNSQAKIVK

SEQ ID NO: 41882 - protein, 11 aa, Artificial Sequence
  Peptide Derived from Human Papillomavirus
SSCVDYNISPR

SEQ ID NO: 41883 - protein, 9 aa, Artificial Sequence
  Peptide Derived from Human Papillomavirus
STAAALYWY

SEQ ID NO: 41884 - protein, 10 aa, Artificial Sequence
  Peptide Derived from Human Papillomavirus
STAAALYWYR

SEQ ID NO: 41885 - protein, 11 aa, Artificial Sequence
  Peptide Derived from Human Papillomavirus
STNCMLIQPPK

SEQ ID NO: 41886 - protein, 8 aa, Artificial Sequence
  Peptide Derived from Human Papillomavirus
TAAALYWY

SEQ ID NO: 41887 - protein, 9 aa, Artificial Sequence
  Peptide Derived from Human Papillomavirus
TAAALYWYR

SEQ ID NO: 41888 - protein, 11 aa, Artificial Sequence
  Peptide Derived from Human Papillomavirus
TFKCVSGQNIR

SEQ ID NO: 41889 - protein, 10 aa, Artificial Sequence
  Peptide Derived from Human Papillomavirus
TFPNPFPFDK

SEQ ID NO: 41890 - protein, 8 aa, Artificial Sequence
  Peptide Derived from Human Papillomavirus
TGCNGWFY

SEQ ID NO: 41891 - protein, 10 aa, Artificial Sequence
  Peptide Derived from Human Papillomavirus
TGMSNISDVY

SEQ ID NO: 41892 - protein, 9 aa, Artificial Sequence
  Peptide Derived from Human Papillomavirus
TGTVAEGFK

SEQ ID NO: 41893 - protein, 8 aa, Artificial Sequence
  Peptide Derived from Human Papillomavirus
TIEKLLEK

SEQ ID NO: 41894 - protein, 9 aa, Artificial Sequence
  Peptide Derived from Human Papillomavirus
TLLQPYCLY

SEQ ID NO: 41895 - protein, 11 aa, Artificial Sequence
  Peptide Derived from Human Papillomavirus
TLLQPYCLYCH

SEQ ID NO: 41896 - protein, 11 aa, Artificial Sequence
  Peptide Derived from Human Papillomavirus
TLSCNGSDGTH

SEQ ID NO: 41897 - protein, 8 aa, Artificial Sequence
  Peptide Derived from Human Papillomavirus
TMCRHYKR

SEQ ID NO: 41898 - protein, 11 aa, Artificial Sequence
  Peptide Derived from Human Papillomavirus
TMCRHYKRAEK

SEQ ID NO: 41899 - protein, 10 aa, Artificial Sequence
  Peptide Derived from Human Papillomavirus
TNCMLIQPPK

SEQ ID NO: 41900 - protein, 11 aa, Artificial Sequence
  Peptide Derived from Human Papillomavirus
TSNGKAAMLGK

SEQ ID NO: 41901 - protein, 8 aa, Artificial Sequence
  Peptide Derived from Human Papillomavirus
TSNINAGK

SEQ ID NO: 41902 - protein, 11 aa, Artificial Sequence
  Peptide Derived from Human Papillomavirus
TSNINAGKDDR

SEQ ID NO: 41903 - protein, 11 aa, Artificial Sequence
  Peptide Derived from Human Papillomavirus
TTPCWHYIDNY

SEQ ID NO: 41904 - protein, 10 aa, Artificial Sequence
  Peptide Derived from Human Papillomavirus
VDFIDNCNVY

SEQ ID NO: 41905 - protein, 8 aa, Artificial Sequence
  Peptide Derived from Human Papillomavirus
VDYNISPR

SEQ ID NO: 41906 - protein, 10 aa, Artificial Sequence
  Peptide Derived from Human Papillomavirus
VDYNISPRLK

SEQ ID NO: 41907 - protein, 8 aa, Artificial Sequence
  Peptide Derived from Human Papillomavirus
VLKTSNGK

SEQ ID NO: 41908 - protein, 9 aa, Artificial Sequence
  Peptide Derived from Human Papillomavirus
VMDDSEIAY

SEQ ID NO: 41909 - protein, 10 aa, Artificial Sequence
  Peptide Derived from Human Papillomavirus
VMDDSEIAYK

SEQ ID NO: 41910 - protein, 11 aa, Artificial Sequence
  Peptide Derived from Human Papillomavirus
VMDDSEIAYKY

SEQ ID NO: 41911 - protein, 9 aa, Artificial Sequence
  Peptide Derived from Human Papillomavirus
VMLMLVRFK

SEQ ID NO: 41912 - protein, 8 aa, Artificial Sequence
  Peptide Derived from Human Papillomavirus
VSDEGDWR

SEQ ID NO: 41913 - protein, 8 aa, Artificial Sequence
  Peptide Derived from Human Papillomavirus
VSFLSALK

SEQ ID NO: 41914 - protein, 8 aa, Artificial Sequence
  Peptide Derived from Human Papillomavirus
VSFMELIR

SEQ ID NO: 41915 - protein, 8 aa, Artificial Sequence
  Peptide Derived from Human Papillomavirus
VSIDVKHK

SEQ ID NO: 41916 - protein, 10 aa, Artificial Sequence
  Peptide Derived from Human Papillomavirus
VTGTVAEGFK

SEQ ID NO: 41917 - protein, 10 aa, Artificial Sequence
  Peptide Derived from Human Papillomavirus
WFYVEAVIDR

SEQ ID NO: 41918 - protein, 10 aa, Artificial Sequence
  Peptide Derived from Human Papillomavirus
WGMVMLMLVR

SEQ ID NO: 41919 - protein, 10 aa, Artificial Sequence
  Peptide Derived from Human Papillomavirus
WIERQTVLQH

SEQ ID NO: 41920 - protein, 8 aa, Artificial Sequence
  Peptide Derived from Human Papillomavirus
WIKSRCDK

SEQ ID NO: 41921 - protein, 9 aa, Artificial Sequence
  Peptide Derived from Human Papillomavirus
WLQPLADAK

SEQ ID NO: 41922 - protein, 10 aa, Artificial Sequence
  Peptide Derived from Human Papillomavirus
YGETPEWIER

SEQ ID NO: 41923 - protein, 10 aa, Artificial Sequence
  Peptide Derived from Human Papillomavirus
YGVSFMELIR

SEQ ID NO: 41924 - protein, 8 aa, Artificial Sequence
  Peptide Derived from Human Papillomavirus
YNISPRLK

SEQ ID NO: 41925 - protein, 8 aa, Artificial Sequence
  Peptide Derived from Human Papillomavirus
YVEAVIDR

SEQ ID NO: 41926 - protein, 9 aa, Artificial Sequence
  Peptide Derived from Human Papillomavirus
AAACTNQTR

SEQ ID NO: 41927 - protein, 8 aa, Artificial Sequence
  Peptide Derived from Human Papillomavirus
AACTNQTR

SEQ ID NO: 41928 - protein, 9 aa, Artificial Sequence
  Peptide Derived from Human Papillomavirus
ALGTSEGVR

SEQ ID NO: 41929 - protein, 10 aa, Artificial Sequence
  Peptide Derived from Human Papillomavirus
ALGTSEGVRR

SEQ ID NO: 41930 - protein, 8 aa, Artificial Sequence
  Peptide Derived from Human Papillomavirus
ALSVSKAK

SEQ ID NO: 41931 - protein, 8 aa, Artificial Sequence
  Peptide Derived from Human Papillomavirus
ANILKCLR

SEQ ID NO: 41932 - protein, 9 aa, Artificial Sequence
  Peptide Derived from Human Papillomavirus
ANILKCLRY

SEQ ID NO: 41933 - protein, 10 aa, Artificial Sequence
  Peptide Derived from Human Papillomavirus
ANILKCLRYR

SEQ ID NO: 41934 - protein, 10 aa, Artificial Sequence
  Peptide Derived from Human Papillomavirus
ANNTTTSNSK

SEQ ID NO: 41935 - protein, 9 aa, Artificial Sequence
  Peptide Derived from Human Papillomavirus
ATTPIIHLK

SEQ ID NO: 41936 - protein, 9 aa, Artificial Sequence
  Peptide Derived from Human Papillomavirus
ATTSTKRPR

SEQ ID NO: 41937 - protein, 10 aa, Artificial Sequence
  Peptide Derived from Human Papillomavirus
CALGTSEGVR

SEQ ID NO: 41938 - protein, 11 aa, Artificial Sequence
  Peptide Derived from Human Papillomavirus
CALGTSEGVRR

SEQ ID NO: 41939 - protein, 8 aa, Artificial Sequence
  Peptide Derived from Human Papillomavirus
CDHIDYWK

SEQ ID NO: 41940 - protein, 9 aa, Artificial Sequence
  Peptide Derived from Human Papillomavirus
CDHIDYWKH

SEQ ID NO: 41941 - protein, 11 aa, Artificial Sequence
  Peptide Derived from Human Papillomavirus
CDHIDYWKHIR

SEQ ID NO: 41942 - protein, 8 aa, Artificial Sequence
  Peptide Derived from Human Papillomavirus
CLRYRLSK

SEQ ID NO: 41943 - protein, 9 aa, Artificial Sequence
  Peptide Derived from Human Papillomavirus
CLRYRLSKY

SEQ ID NO: 41944 - protein, 10 aa, Artificial Sequence
  Peptide Derived from Human Papillomavirus
CLRYRLSKYK

SEQ ID NO: 41945 - protein, 11 aa, Artificial Sequence
  Peptide Derived from Human Papillomavirus
CTVVEGQVNCK

SEQ ID NO: 41946 - protein, 8 aa, Artificial Sequence
  Peptide Derived from Human Papillomavirus
CVLMYKAR

SEQ ID NO: 41947 - protein, 9 aa, Artificial Sequence
  Peptide Derived from Human Papillomavirus
DANILKCLR

SEQ ID NO: 41948 - protein, 10 aa, Artificial Sequence
  Peptide Derived from Human Papillomavirus
DANILKCLRY

SEQ ID NO: 41949 - protein, 11 aa, Artificial Sequence
  Peptide Derived from Human Papillomavirus
DANILKCLRYR

SEQ ID NO: 41950 - protein, 8 aa, Artificial Sequence
  Peptide Derived from Human Papillomavirus
DDFLNTVK

SEQ ID NO: 41951 - protein, 9 aa, Artificial Sequence
  Peptide Derived from Human Papillomavirus
DGDVHNTMH

SEQ ID NO: 41952 - protein, 10 aa, Artificial Sequence
  Peptide Derived from Human Papillomavirus
DGDVHNTMHY

SEQ ID NO: 41953 - protein, 8 aa, Artificial Sequence
  Peptide Derived from Human Papillomavirus
DSKRLCDH

SEQ ID NO: 41954 - protein, 11 aa, Artificial Sequence
  Peptide Derived from Human Papillomavirus
DSKRLCDHIDY

SEQ ID NO: 41955 - protein, 8 aa, Artificial Sequence
  Peptide Derived from Human Papillomavirus
DVHNTMHY

SEQ ID NO: 41956 - protein, 9 aa, Artificial Sequence
  Peptide Derived from Human Papillomavirus
EAKKYGTGK

SEQ ID NO: 41957 - protein, 10 aa, Artificial Sequence
  Peptide Derived from Human Papillomavirus
EAKKYGTGKK

SEQ ID NO: 41958 - protein, 9 aa, Artificial Sequence
  Peptide Derived from Human Papillomavirus
ECVLMYKAR

SEQ ID NO: 41959 - protein, 10 aa, Artificial Sequence
  Peptide Derived from Human Papillomavirus
EGQVNCKGIY

SEQ ID NO: 41960 - protein, 11 aa, Artificial Sequence
  Peptide Derived from Human Papillomavirus
EGQVNCKGIYY

SEQ ID NO: 41961 - protein, 11 aa, Artificial Sequence
  Peptide Derived from Human Papillomavirus
EGVRRATTSTK

SEQ ID NO: 41962 - protein, 10 aa, Artificial Sequence
  Peptide Derived from Human Papillomavirus
EISFAGIVTK

SEQ ID NO: 41963 - protein, 9 aa, Artificial Sequence
  Peptide Derived from Human Papillomavirus
EMGIHSINH

SEQ ID NO: 41964 - protein, 10 aa, Artificial Sequence
  Peptide Derived from Human Papillomavirus
ENDSKRLCDH

SEQ ID NO: 41965 - protein, 8 aa, Artificial Sequence
  Peptide Derived from Human Papillomavirus
ETLNNTEY

SEQ ID NO: 41966 - protein, 9 aa, Artificial Sequence
  Peptide Derived from Human Papillomavirus
ETLNNTEYK

SEQ ID NO: 41967 - protein, 9 aa, Artificial Sequence
  Peptide Derived from Human Papillomavirus
EVQFDGDVH

SEQ ID NO: 41968 - protein, 10 aa, Artificial Sequence
  Peptide Derived from Human Papillomavirus
FDGDVHNTMH

SEQ ID NO: 41969 - protein, 11 aa, Artificial Sequence
  Peptide Derived from Human Papillomavirus
FDGDVHNTMHY

SEQ ID NO: 41970 - protein, 8 aa, Artificial Sequence
  Peptide Derived from Human Papillomavirus
FTEEAKKY

SEQ ID NO: 41971 - protein, 9 aa, Artificial Sequence
  Peptide Derived from Human Papillomavirus
FVNFTEEAK

SEQ ID NO: 41972 - protein, 10 aa, Artificial Sequence
  Peptide Derived from Human Papillomavirus
FVNFTEEAKK

SEQ ID NO: 41973 - protein, 11 aa, Artificial Sequence
  Peptide Derived from Human Papillomavirus
FVNFTEEAKKY

SEQ ID NO: 41974 - protein, 8 aa, Artificial Sequence
  Peptide Derived from Human Papillomavirus
GCLKKHGY

SEQ ID NO: 41975 - protein, 10 aa, Artificial Sequence
  Peptide Derived from Human Papillomavirus
GDANILKCLR

SEQ ID NO: 41976 - protein, 11 aa, Artificial Sequence
  Peptide Derived from Human Papillomavirus
GDANILKCLRY

SEQ ID NO: 41977 - protein, 8 aa, Artificial Sequence
  Peptide Derived from Human Papillomavirus
GDVHNTMH

SEQ ID NO: 41978 - protein, 9 aa, Artificial Sequence
  Peptide Derived from Human Papillomavirus
GDVHNTMHY

SEQ ID NO: 41979 - protein, 9 aa, Artificial Sequence
  Peptide Derived from Human Papillomavirus
GIYYVHEGH

SEQ ID NO: 41980 - protein, 9 aa, Artificial Sequence
  Peptide Derived from Human Papillomavirus
GTGKKWEVH

SEQ ID NO: 41981 - protein, 8 aa, Artificial Sequence
  Peptide Derived from Human Papillomavirus
GTSEGVRR

SEQ ID NO: 41982 - protein, 10 aa, Artificial Sequence
  Peptide Derived from Human Papillomavirus
GVRRATTSTK

SEQ ID NO: 41983 - protein, 11 aa, Artificial Sequence
  Peptide Derived from Human Papillomavirus
GVRRATTSTKR

SEQ ID NO: 41984 - protein, 9 aa, Artificial Sequence
  Peptide Derived from Human Papillomavirus
HIDYWKHIR

SEQ ID NO: 41985 - protein, 10 aa, Artificial Sequence
  Peptide Derived from Human Papillomavirus
HIRLECVLMY

SEQ ID NO: 41986 - protein, 11 aa, Artificial Sequence
  Peptide Derived from Human Papillomavirus
HIRLECVLMYK

SEQ ID NO: 41987 - protein, 10 aa, Artificial Sequence
  Peptide Derived from Human Papillomavirus
HLKGDANILK

SEQ ID NO: 41988 - protein, 10 aa, Artificial Sequence
  Peptide Derived from Human Papillomavirus
HNTMHYTNWK

SEQ ID NO: 41989 - protein, 8 aa, Artificial Sequence
  Peptide Derived from Human Papillomavirus
IDYWKHIR

SEQ ID NO: 41990 - protein, 10 aa, Artificial Sequence
  Peptide Derived from Human Papillomavirus
ILEHYENDSK

SEQ ID NO: 41991 - protein, 11 aa, Artificial Sequence
  Peptide Derived from Human Papillomavirus
ILEHYENDSKR

SEQ ID NO: 41992 - protein, 8 aa, Artificial Sequence
  Peptide Derived from Human Papillomavirus
ILKCLRYR

SEQ ID NO: 41993 - protein, 11 aa, Artificial Sequence
  Peptide Derived from Human Papillomavirus
ILKCLRYRLSK

SEQ ID NO: 41994 - protein, 11 aa, Artificial Sequence
  Peptide Derived from Human Papillomavirus
ISAAACTNQTR

SEQ ID NO: 41995 - protein, 9 aa, Artificial Sequence
  Peptide Derived from Human Papillomavirus
ISFAGIVTK

SEQ ID NO: 41996 - protein, 8 aa, Artificial Sequence
  Peptide Derived from Human Papillomavirus
KAREMGIH

SEQ ID NO: 41997 - protein, 9 aa, Artificial Sequence
  Peptide Derived from Human Papillomavirus
KCLRYRLSK

SEQ ID NO: 41998 - protein, 10 aa, Artificial Sequence
  Peptide Derived from Human Papillomavirus
KCLRYRLSKY

SEQ ID NO: 41999 - protein, 11 aa, Artificial Sequence
  Peptide Derived from Human Papillomavirus
KCLRYRLSKYK

SEQ ID NO: 42000 - protein, 8 aa, Artificial Sequence
  Peptide Derived from Human Papillomavirus
KGDANILK

SEQ ID NO: 42001 - protein, 11 aa, Artificial Sequence
  Peptide Derived from Human Papillomavirus
KGDANILKCLR

SEQ ID NO: 42002 - protein, 10 aa, Artificial Sequence
  Peptide Derived from Human Papillomavirus
KGIYYVHEGH

SEQ ID NO: 42003 - protein, 11 aa, Artificial Sequence
  Peptide Derived from Human Papillomavirus
KILEHYENDSK

SEQ ID NO: 42004 - protein, 9 aa, Artificial Sequence
  Peptide Derived from Human Papillomavirus
KNAIVTLTY

SEQ ID NO: 42005 - protein, 9 aa, Artificial Sequence
  Peptide Derived from Human Papillomavirus
LCDHIDYWK

SEQ ID NO: 42006 - protein, 10 aa, Artificial Sequence
  Peptide Derived from Human Papillomavirus
LCDHIDYWKH

SEQ ID NO: 42007 - protein, 8 aa, Artificial Sequence
  Peptide Derived from Human Papillomavirus
LGTSEGVR

SEQ ID NO: 42008 - protein, 9 aa, Artificial Sequence
  Peptide Derived from Human Papillomavirus
LGTSEGVRR

SEQ ID NO: 42009 - protein, 11 aa, Artificial Sequence
  Peptide Derived from Human Papillomavirus
LMYKAREMGIH

SEQ ID NO: 42010 - protein, 11 aa, Artificial Sequence
  Peptide Derived from Human Papillomavirus
LNVCQDKILEH

SEQ ID NO: 42011 - protein, 8 aa, Artificial Sequence
  Peptide Derived from Human Papillomavirus
LSKYKQLY

SEQ ID NO: 42012 - protein, 11 aa, Artificial Sequence
  Peptide Derived from Human Papillomavirus
LSQRLNVCQDK

SEQ ID NO: 42013 - protein, 9 aa, Artificial Sequence
  Peptide Derived from Human Papillomavirus
LTAPTGCLK

SEQ ID NO: 42014 - protein, 10 aa, Artificial Sequence
  Peptide Derived from Human Papillomavirus
LTAPTGCLKK

SEQ ID NO: 42015 - protein, 11 aa, Artificial Sequence
  Peptide Derived from Human Papillomavirus
LTAPTGCLKKH

SEQ ID NO: 42016 - protein, 9 aa, Artificial Sequence
  Peptide Derived from Human Papillomavirus
LTYISTSQR

SEQ ID NO: 42017 - protein, 8 aa, Artificial Sequence
  Peptide Derived from Human Papillomavirus
MGIHSINH

SEQ ID NO: 42018 - protein, 10 aa, Artificial Sequence
  Peptide Derived from Human Papillomavirus
MLETLNNTEY

SEQ ID NO: 42019 - protein, 11 aa, Artificial Sequence
  Peptide Derived from Human Papillomavirus
MLETLNNTEYK

SEQ ID NO: 42020 - protein, 11 aa, Artificial Sequence
  Peptide Derived from Human Papillomavirus
MMLETLNNTEY

SEQ ID NO: 42021 - protein, 8 aa, Artificial Sequence
  Peptide Derived from Human Papillomavirus
NAIVTLTY

SEQ ID NO: 42022 - protein, 9 aa, Artificial Sequence
  Peptide Derived from Human Papillomavirus
NCKGIYYVH

SEQ ID NO: 42023 - protein, 9 aa, Artificial Sequence
  Peptide Derived from Human Papillomavirus
NDSKRLCDH

SEQ ID NO: 42024 - protein, 8 aa, Artificial Sequence
  Peptide Derived from Human Papillomavirus
NFTEEAKK

SEQ ID NO: 42025 - protein, 9 aa, Artificial Sequence
  Peptide Derived from Human Papillomavirus
NFTEEAKKY

SEQ ID NO: 42026 - protein, 8 aa, Artificial Sequence
  Peptide Derived from Human Papillomavirus
NILKCLRY

SEQ ID NO: 42027 - protein, 9 aa, Artificial Sequence
  Peptide Derived from Human Papillomavirus
NILKCLRYR

SEQ ID NO: 42028 - protein, 9 aa, Artificial Sequence
  Peptide Derived from Human Papillomavirus
NNTTTSNSK

SEQ ID NO: 42029 - protein, 10 aa, Artificial Sequence
  Peptide Derived from Human Papillomavirus
NTHHPNKLLR

SEQ ID NO: 42030 - protein, 9 aa, Artificial Sequence
  Peptide Derived from Human Papillomavirus
NTMHYTNWK

SEQ ID NO: 42031 - protein, 8 aa, Artificial Sequence
  Peptide Derived from Human Papillomavirus
NTTTSNSK

SEQ ID NO: 42032 - protein, 9 aa, Artificial Sequence
  Peptide Derived from Human Papillomavirus
NTVSVSTGY

SEQ ID NO: 42033 - protein, 10 aa, Artificial Sequence
  Peptide Derived from Human Papillomavirus
NVCQDKILEH

SEQ ID NO: 42034 - protein, 11 aa, Artificial Sequence
  Peptide Derived from Human Papillomavirus
NVCQDKILEHY

SEQ ID NO: 42035 - protein, 9 aa, Artificial Sequence
  Peptide Derived from Human Papillomavirus
PALSVSKAK

SEQ ID NO: 42036 - protein, 8 aa, Artificial Sequence
  Peptide Derived from Human Papillomavirus
PATTPIIH

SEQ ID NO: 42037 - protein, 10 aa, Artificial Sequence
  Peptide Derived from Human Papillomavirus
PATTPIIHLK

SEQ ID NO: 42038 - protein, 10 aa, Artificial Sequence
  Peptide Derived from Human Papillomavirus
PNTVSVSTGY

SEQ ID NO: 42039 - protein, 8 aa, Artificial Sequence
  Peptide Derived from Human Papillomavirus
PTGCLKKH

SEQ ID NO: 42040 - protein, 10 aa, Artificial Sequence
  Peptide Derived from Human Papillomavirus
PTGCLKKHGY

SEQ ID NO: 42041 - protein, 8 aa, Artificial Sequence
  Peptide Derived from Human Papillomavirus
QDKILEHY

SEQ ID NO: 42042 - protein, 11 aa, Artificial Sequence
  Peptide Derived from Human Papillomavirus
QFDGDVHNTMH

SEQ ID NO: 42043 - protein, 11 aa, Artificial Sequence
  Peptide Derived from Human Papillomavirus
QLYEQVSSTWH

SEQ ID NO: 42044 - protein, 8 aa, Artificial Sequence
  Peptide Derived from Human Papillomavirus
QVNCKGIY

SEQ ID NO: 42045 - protein, 9 aa, Artificial Sequence
  Peptide Derived from Human Papillomavirus
QVNCKGIYY

SEQ ID NO: 42046 - protein, 11 aa, Artificial Sequence
  Peptide Derived from Human Papillomavirus
QVNCKGIYYVH

SEQ ID NO: 42047 - protein, 10 aa, Artificial Sequence
  Peptide Derived from Human Papillomavirus
QVVPALSVSK

SEQ ID NO: 42048 - protein, 8 aa, Artificial Sequence
  Peptide Derived from Human Papillomavirus
RATTSTKR

SEQ ID NO: 42049 - protein, 10 aa, Artificial Sequence
  Peptide Derived from Human Papillomavirus
RATTSTKRPR

SEQ ID NO: 42050 - protein, 9 aa, Artificial Sequence
  Peptide Derived from Human Papillomavirus
RDDFLNTVK

SEQ ID NO: 42051 - protein, 8 aa, Artificial Sequence
  Peptide Derived from Human Papillomavirus
RLCDHIDY

SEQ ID NO: 42052 - protein, 10 aa, Artificial Sequence
  Peptide Derived from Human Papillomavirus
RLCDHIDYWK

SEQ ID NO: 42053 - protein, 11 aa, Artificial Sequence
  Peptide Derived from Human Papillomavirus
RLCDHIDYWKH

SEQ ID NO: 42054 - protein, 8 aa, Artificial Sequence
  Peptide Derived from Human Papillomavirus
RLECVLMY

SEQ ID NO: 42055 - protein, 9 aa, Artificial Sequence
  Peptide Derived from Human Papillomavirus
RLECVLMYK

SEQ ID NO: 42056 - protein, 11 aa, Artificial Sequence
  Peptide Derived from Human Papillomavirus
RLECVLMYKAR

SEQ ID NO: 42057 - protein, 8 aa, Artificial Sequence
  Peptide Derived from Human Papillomavirus
RLNVCQDK

SEQ ID NO: 42058 - protein, 9 aa, Artificial Sequence
  Peptide Derived from Human Papillomavirus
RLSKYKQLY

SEQ ID NO: 42059 - protein, 8 aa, Artificial Sequence
  Peptide Derived from Human Papillomavirus
RNTHHPNK

SEQ ID NO: 42060 - protein, 11 aa, Artificial Sequence
  Peptide Derived from Human Papillomavirus
RNTHHPNKLLR

SEQ ID NO: 42061 - protein, 10 aa, Artificial Sequence
  Peptide Derived from Human Papillomavirus
RTEPEHRNTH

SEQ ID NO: 42062 - protein, 11 aa, Artificial Sequence
  Peptide Derived from Human Papillomavirus
RTEPEHRNTHH

SEQ ID NO: 42063 - protein, 10 aa, Artificial Sequence
  Peptide Derived from Human Papillomavirus
SAAACTNQTR

SEQ ID NO: 42064 - protein, 10 aa, Artificial Sequence
  Peptide Derived from Human Papillomavirus
SCPATTPIIH

SEQ ID NO: 42065 - protein, 8 aa, Artificial Sequence
  Peptide Derived from Human Papillomavirus
SFAGIVTK

SEQ ID NO: 42066 - protein, 11 aa, Artificial Sequence
  Peptide Derived from Human Papillomavirus
STKRPRTEPEH

SEQ ID NO: 42067 - protein, 11 aa, Artificial Sequence
  Peptide Derived from Human Papillomavirus
STWHWTCTDGK

SEQ ID NO: 42068 - protein, 11 aa, Artificial Sequence
  Peptide Derived from Human Papillomavirus
TANNTTTSNSK

SEQ ID NO: 42069 - protein, 8 aa, Artificial Sequence
  Peptide Derived from Human Papillomavirus
TAPTGCLK

SEQ ID NO: 42070 - protein, 9 aa, Artificial Sequence
  Peptide Derived from Human Papillomavirus
TAPTGCLKK

SEQ ID NO: 42071 - protein, 10 aa, Artificial Sequence
  Peptide Derived from Human Papillomavirus
TAPTGCLKKH

SEQ ID NO: 42072 - protein, 11 aa, Artificial Sequence
  Peptide Derived from Human Papillomavirus
TCALGTSEGVR

SEQ ID NO: 42073 - protein, 8 aa, Artificial Sequence
  Peptide Derived from Human Papillomavirus
TCTDGKHK

SEQ ID NO: 42074 - protein, 9 aa, Artificial Sequence
  Peptide Derived from Human Papillomavirus
TGCLKKHGY

SEQ ID NO: 42075 - protein, 8 aa, Artificial Sequence
  Peptide Derived from Human Papillomavirus
TGKKWEVH

SEQ ID NO: 42076 - protein, 8 aa, Artificial Sequence
  Peptide Derived from Human Papillomavirus
TLNNTEYK

SEQ ID NO: 42077 - protein, 10 aa, Artificial Sequence
  Peptide Derived from Human Papillomavirus
TLTYISTSQR

SEQ ID NO: 42078 - protein, 8 aa, Artificial Sequence
  Peptide Derived from Human Papillomavirus
TMHYTNWK

SEQ ID NO: 42079 - protein, 11 aa, Artificial Sequence
  Peptide Derived from Human Papillomavirus
TMHYTNWKFIY

SEQ ID NO: 42080 - protein, 10 aa, Artificial Sequence
  Peptide Derived from Human Papillomavirus
TMQQTSLELY

SEQ ID NO: 42081 - protein, 8 aa, Artificial Sequence
  Peptide Derived from Human Papillomavirus
TTPIIHLK

SEQ ID NO: 42082 - protein, 8 aa, Artificial Sequence
  Peptide Derived from Human Papillomavirus
TTSTKRPR

SEQ ID NO: 42083 - protein, 11 aa, Artificial Sequence
  Peptide Derived from Human Papillomavirus
TVEVQFDGDVH

SEQ ID NO: 42084 - protein, 8 aa, Artificial Sequence
  Peptide Derived from Human Papillomavirus
TVSVSTGY

SEQ ID NO: 42085 - protein, 10 aa, Artificial Sequence
  Peptide Derived from Human Papillomavirus
TVVEGQVNCK

SEQ ID NO: 42086 - protein, 9 aa, Artificial Sequence
  Peptide Derived from Human Papillomavirus
VCQDKILEH

SEQ ID NO: 42087 - protein, 10 aa, Artificial Sequence
  Peptide Derived from Human Papillomavirus
VCQDKILEHY

SEQ ID NO: 42088 - protein, 8 aa, Artificial Sequence
  Peptide Derived from Human Papillomavirus
VNCKGIYY

SEQ ID NO: 42089 - protein, 10 aa, Artificial Sequence
  Peptide Derived from Human Papillomavirus
VNCKGIYYVH

SEQ ID NO: 42090 - protein, 8 aa, Artificial Sequence
  Peptide Derived from Human Papillomavirus
VNFTEEAK

SEQ ID NO: 42091 - protein, 9 aa, Artificial Sequence
  Peptide Derived from Human Papillomavirus
VNFTEEAKK

SEQ ID NO: 42092 - protein, 10 aa, Artificial Sequence
  Peptide Derived from Human Papillomavirus
VNFTEEAKKY

SEQ ID NO: 42093 - protein, 11 aa, Artificial Sequence
  Peptide Derived from Human Papillomavirus
VSCPATTPIIH

SEQ ID NO: 42094 - protein, 11 aa, Artificial Sequence
  Peptide Derived from Human Papillomavirus
VTLTYISTSQR

SEQ ID NO: 42095 - protein, 9 aa, Artificial Sequence
  Peptide Derived from Human Papillomavirus
VVEGQVNCK

SEQ ID NO: 42096 - protein, 9 aa, Artificial Sequence
  Peptide Derived from Human Papillomavirus
VVPALSVSK

SEQ ID NO: 42097 - protein, 11 aa, Artificial Sequence
  Peptide Derived from Human Papillomavirus
VVPALSVSKAK

SEQ ID NO: 42098 - protein, 8 aa, Artificial Sequence
  Peptide Derived from Human Papillomavirus
WTCTDGKH

SEQ ID NO: 42099 - protein, 9 aa, Artificial Sequence
  Peptide Derived from Human Papillomavirus
WTCTDGKHK

SEQ ID NO: 42100 - protein, 11 aa, Artificial Sequence
  Peptide Derived from Human Papillomavirus
WTMQQTSLELY

SEQ ID NO: 42101 - protein, 10 aa, Artificial Sequence
  Peptide Derived from Human Papillomavirus
YFVNFTEEAK

SEQ ID NO: 42102 - protein, 11 aa, Artificial Sequence
  Peptide Derived from Human Papillomavirus
YFVNFTEEAKK

SEQ ID NO: 42103 - protein, 10 aa, Artificial Sequence
  Peptide Derived from Human Papillomavirus
YGTGKKWEVH

SEQ ID NO: 42104 - protein, 10 aa, Artificial Sequence
  Peptide Derived from Human Papillomavirus
YLTAPTGCLK

SEQ ID NO: 42105 - protein, 11 aa, Artificial Sequence
  Peptide Derived from Human Papillomavirus
YLTAPTGCLKK

SEQ ID NO: 42106 - protein, 8 aa, Artificial Sequence
  Peptide Derived from Human Papillomavirus
YTNWKFIY

SEQ ID NO: 42107 - protein, 9 aa, Artificial Sequence
  Peptide Derived from Human Papillomavirus
YVHEGHITY

SEQ ID NO: 42108 - protein, 11 aa, Artificial Sequence
  Peptide Derived from Human Papillomavirus
ATSPLRCFCIY

SEQ ID NO: 42109 - protein, 10 aa, Artificial Sequence
  Peptide Derived from Human Papillomavirus
CFCIYVVFIY

SEQ ID NO: 42110 - protein, 8 aa, Artificial Sequence
  Peptide Derived from Human Papillomavirus
CIYVVFIY

SEQ ID NO: 42111 - protein, 11 aa, Artificial Sequence
  Peptide Derived from Human Papillomavirus
CVLLFVCLVIR

SEQ ID NO: 42112 - protein, 9 aa, Artificial Sequence
  Peptide Derived from Human Papillomavirus
FCIYVVFIY

SEQ ID NO: 42113 - protein, 10 aa, Artificial Sequence
  Peptide Derived from Human Papillomavirus
FIYIPLFVIH

SEQ ID NO: 42114 - protein, 11 aa, Artificial Sequence
  Peptide Derived from Human Papillomavirus
ILWVIATSPLR

SEQ ID NO: 42115 - protein, 8 aa, Artificial Sequence
  Peptide Derived from Human Papillomavirus
LFVCLVIR

SEQ ID NO: 42116 - protein, 9 aa, Artificial Sequence
  Peptide Derived from Human Papillomavirus
LLFVCLVIR

SEQ ID NO: 42117 - protein, 8 aa, Artificial Sequence
  Peptide Derived from Human Papillomavirus
LVLSVSVY

SEQ ID NO: 42118 - protein, 8 aa, Artificial Sequence
  Peptide Derived from Human Papillomavirus
PLFVIHTH

SEQ ID NO: 42119 - protein, 8 aa, Artificial Sequence
  Peptide Derived from Human Papillomavirus
PLRCFCIY

SEQ ID NO: 42120 - protein, 9 aa, Artificial Sequence
  Peptide Derived from Human Papillomavirus
PLVLSVSVY

SEQ ID NO: 42121 - protein, 11 aa, Artificial Sequence
  Peptide Derived from Human Papillomavirus
RCFCIYVVFIY

SEQ ID NO: 42122 - protein, 10 aa, Artificial Sequence
  Peptide Derived from Human Papillomavirus
TSPLRCFCIY

SEQ ID NO: 42123 - protein, 11 aa, Artificial Sequence
  Peptide Derived from Human Papillomavirus
VFIYIPLFVIH

SEQ ID NO: 42124 - protein, 8 aa, Artificial Sequence
  Peptide Derived from Human Papillomavirus
VIATSPLR

SEQ ID NO: 42125 - protein, 10 aa, Artificial Sequence
  Peptide Derived from Human Papillomavirus
VLLFVCLVIR

SEQ ID NO: 42126 - protein, 9 aa, Artificial Sequence
  Peptide Derived from Human Papillomavirus
WVIATSPLR

SEQ ID NO: 42127 - protein, 8 aa, Artificial Sequence
  Peptide Derived from Human Papillomavirus
YIPLFVIH

SEQ ID NO: 42128 - protein, 10 aa, Artificial Sequence
  Peptide Derived from Human Papillomavirus
YIPLFVIHTH

SEQ ID NO: 42129 - protein, 9 aa, Artificial Sequence
  Peptide Derived from Human Papillomavirus
AFTDLTIVY

SEQ ID NO: 42130 - protein, 10 aa, Artificial Sequence
  Peptide Derived from Human Papillomavirus
AFTDLTIVYR

SEQ ID NO: 42131 - protein, 10 aa, Artificial Sequence
  Peptide Derived from Human Papillomavirus
ALEIPYDELR

SEQ ID NO: 42132 - protein, 9 aa, Artificial Sequence
  Peptide Derived from Human Papillomavirus
CIACWRRPR

SEQ ID NO: 42133 - protein, 8 aa, Artificial Sequence
  Peptide Derived from Human Papillomavirus
CTKCLRFY

SEQ ID NO: 42134 - protein, 10 aa, Artificial Sequence
  Peptide Derived from Human Papillomavirus
CTKCLRFYSK

SEQ ID NO: 42135 - protein, 10 aa, Artificial Sequence
  Peptide Derived from Human Papillomavirus
DDTPHGVCTK

SEQ ID NO: 42136 - protein, 11 aa, Artificial Sequence
  Peptide Derived from Human Papillomavirus
DFAFTDLTIVY

SEQ ID NO: 42137 - protein, 11 aa, Artificial Sequence
  Peptide Derived from Human Papillomavirus
DLLIRCITCQR

SEQ ID NO: 42138 - protein, 9 aa, Artificial Sequence
  Peptide Derived from Human Papillomavirus
DTPHGVCTK

SEQ ID NO: 42139 - protein, 10 aa, Artificial Sequence
  Peptide Derived from Human Papillomavirus
EFRWYRYSVY

SEQ ID NO: 42140 - protein, 8 aa, Artificial Sequence
  Peptide Derived from Human Papillomavirus
EIPYDELR

SEQ ID NO: 42141 - protein, 8 aa, Artificial Sequence
  Peptide Derived from Human Papillomavirus
ELRLNCVY

SEQ ID NO: 42142 - protein, 10 aa, Artificial Sequence
  Peptide Derived from Human Papillomavirus
ELRLNCVYCK

SEQ ID NO: 42143 - protein, 10 aa, Artificial Sequence
  Peptide Derived from Human Papillomavirus
ELSSALEIPY

SEQ ID NO: 42144 - protein, 10 aa, Artificial Sequence
  Peptide Derived from Human Papillomavirus
FAFTDLTIVY

SEQ ID NO: 42145 - protein, 11 aa, Artificial Sequence
  Peptide Derived from Human Papillomavirus
FAFTDLTIVYR

SEQ ID NO: 42146 - protein, 8 aa, Artificial Sequence
  Peptide Derived from Human Papillomavirus
FTDLTIVY

SEQ ID NO: 42147 - protein, 9 aa, Artificial Sequence
  Peptide Derived from Human Papillomavirus
FTDLTIVYR

SEQ ID NO: 42148 - protein, 8 aa, Artificial Sequence
  Peptide Derived from Human Papillomavirus
GICDLLIR

SEQ ID NO: 42149 - protein, 10 aa, Artificial Sequence
  Peptide Derived from Human Papillomavirus
GTTLEKLTNK

SEQ ID NO: 42150 - protein, 8 aa, Artificial Sequence
  Peptide Derived from Human Papillomavirus
GVCTKCLR

SEQ ID NO: 42151 - protein, 10 aa, Artificial Sequence
  Peptide Derived from Human Papillomavirus
GVCTKCLRFY

SEQ ID NO: 42152 - protein, 9 aa, Artificial Sequence
  Peptide Derived from Human Papillomavirus
HGVCTKCLR

SEQ ID NO: 42153 - protein, 11 aa, Artificial Sequence
  Peptide Derived from Human Papillomavirus
HGVCTKCLRFY

SEQ ID NO: 42154 - protein, 9 aa, Artificial Sequence
  Peptide Derived from Human Papillomavirus
HLDKKKRFH

SEQ ID NO: 42155 - protein, 10 aa, Artificial Sequence
  Peptide Derived from Human Papillomavirus
HNIGGRWTGR

SEQ ID NO: 42156 - protein, 8 aa, Artificial Sequence
  Peptide Derived from Human Papillomavirus
IACWRRPR

SEQ ID NO: 42157 - protein, 8 aa, Artificial Sequence
  Peptide Derived from Human Papillomavirus
IGGRWTGR

SEQ ID NO: 42158 - protein, 9 aa, Artificial Sequence
  Peptide Derived from Human Papillomavirus
IVYRDDTPH

SEQ ID NO: 42159 - protein, 8 aa, Artificial Sequence
  Peptide Derived from Human Papillomavirus
KCLRFYSK

SEQ ID NO: 42160 - protein, 9 aa, Artificial Sequence
  Peptide Derived from Human Papillomavirus
KGICDLLIR

SEQ ID NO: 42161 - protein, 8 aa, Artificial Sequence
  Peptide Derived from Human Papillomavirus
KNPAERPR

SEQ ID NO: 42162 - protein, 9 aa, Artificial Sequence
  Peptide Derived from Human Papillomavirus
KNPAERPRK

SEQ ID NO: 42163 - protein, 11 aa, Artificial Sequence
  Peptide Derived from Human Papillomavirus
KNPAERPRKLH

SEQ ID NO: 42164 - protein, 8 aa, Artificial Sequence
  Peptide Derived from Human Papillomavirus
KVSEFRWY

SEQ ID NO: 42165 - protein, 9 aa, Artificial Sequence
  Peptide Derived from Human Papillomavirus
KVSEFRWYR

SEQ ID NO: 42166 - protein, 10 aa, Artificial Sequence
  Peptide Derived from Human Papillomavirus
KVSEFRWYRY

SEQ ID NO: 42167 - protein, 8 aa, Artificial Sequence
  Peptide Derived from Human Papillomavirus
LCPEEKQR

SEQ ID NO: 42168 - protein, 9 aa, Artificial Sequence
  Peptide Derived from Human Papillomavirus
LCPEEKQRH

SEQ ID NO: 42169 - protein, 8 aa, Artificial Sequence
  Peptide Derived from Human Papillomavirus
LDKKKRFH

SEQ ID NO: 42170 - protein, 9 aa, Artificial Sequence
  Peptide Derived from Human Papillomavirus
LIRCITCQR

SEQ ID NO: 42171 - protein, 10 aa, Artificial Sequence
  Peptide Derived from Human Papillomavirus
LLIRCITCQR

SEQ ID NO: 42172 - protein, 9 aa, Artificial Sequence
  Peptide Derived from Human Papillomavirus
LSSALEIPY

SEQ ID NO: 42173 - protein, 11 aa, Artificial Sequence
  Peptide Derived from Human Papillomavirus
LTIVYRDDTPH

SEQ ID NO: 42174 - protein, 8 aa, Artificial Sequence
  Peptide Derived from Human Papillomavirus
MFKNPAER

SEQ ID NO: 42175 - protein, 10 aa, Artificial Sequence
  Peptide Derived from Human Papillomavirus
MFKNPAERPR

SEQ ID NO: 42176 - protein, 11 aa, Artificial Sequence
  Peptide Derived from Human Papillomavirus
MFKNPAERPRK

SEQ ID NO: 42177 - protein, 9 aa, Artificial Sequence
  Peptide Derived from Human Papillomavirus
NIGGRWTGR

SEQ ID NO: 42178 - protein, 9 aa, Artificial Sequence
  Peptide Derived from Human Papillomavirus
PAERPRKLH

SEQ ID NO: 42179 - protein, 9 aa, Artificial Sequence
  Peptide Derived from Human Papillomavirus
PLCPEEKQR

SEQ ID NO: 42180 - protein, 10 aa, Artificial Sequence
  Peptide Derived from Human Papillomavirus
PLCPEEKQRH

SEQ ID NO: 42181 - protein, 8 aa, Artificial Sequence
  Peptide Derived from Human Papillomavirus
RCIACWRR

SEQ ID NO: 42182 - protein, 10 aa, Artificial Sequence
  Peptide Derived from Human Papillomavirus
RCIACWRRPR

SEQ ID NO: 42183 - protein, 11 aa, Artificial Sequence
  Peptide Derived from Human Papillomavirus
RDDTPHGVCTK

SEQ ID NO: 42184 - protein, 8 aa, Artificial Sequence
  Peptide Derived from Human Papillomavirus
RFHNIGGR

SEQ ID NO: 42185 - protein, 10 aa, Artificial Sequence
  Peptide Derived from Human Papillomavirus
RFYSKVSEFR

SEQ ID NO: 42186 - protein, 8 aa, Artificial Sequence
  Peptide Derived from Human Papillomavirus
RLNCVYCK

SEQ ID NO: 42187 - protein, 11 aa, Artificial Sequence
  Peptide Derived from Human Papillomavirus
SALEIPYDELR

SEQ ID NO: 42188 - protein, 8 aa, Artificial Sequence
  Peptide Derived from Human Papillomavirus
SSALEIPY

SEQ ID NO: 42189 - protein, 9 aa, Artificial Sequence
  Peptide Derived from Human Papillomavirus
SVYGTTLEK

SEQ ID NO: 42190 - protein, 11 aa, Artificial Sequence
  Peptide Derived from Human Papillomavirus
TCQRPLCPEEK

SEQ ID NO: 42191 - protein, 8 aa, Artificial Sequence
  Peptide Derived from Human Papillomavirus
TDLTIVYR

SEQ ID NO: 42192 - protein, 9 aa, Artificial Sequence
  Peptide Derived from Human Papillomavirus
TGRCIACWR

SEQ ID NO: 42193 - protein, 10 aa, Artificial Sequence
  Peptide Derived from Human Papillomavirus
TGRCIACWRR

SEQ ID NO: 42194 - protein, 10 aa, Artificial Sequence
  Peptide Derived from Human Papillomavirus
TIVYRDDTPH

SEQ ID NO: 42195 - protein, 8 aa, Artificial Sequence
  Peptide Derived from Human Papillomavirus
TLEKLTNK

SEQ ID NO: 42196 - protein, 11 aa, Artificial Sequence
  Peptide Derived from Human Papillomavirus
TNKGICDLLIR

SEQ ID NO: 42197 - protein, 9 aa, Artificial Sequence
  Peptide Derived from Human Papillomavirus
TTLEKLTNK

SEQ ID NO: 42198 - protein, 9 aa, Artificial Sequence
  Peptide Derived from Human Papillomavirus
VCTKCLRFY

SEQ ID NO: 42199 - protein, 11 aa, Artificial Sequence
  Peptide Derived from Human Papillomavirus
VCTKCLRFYSK

SEQ ID NO: 42200 - protein, 8 aa, Artificial Sequence
  Peptide Derived from Human Papillomavirus
VSEFRWYR

SEQ ID NO: 42201 - protein, 9 aa, Artificial Sequence
  Peptide Derived from Human Papillomavirus
VSEFRWYRY

SEQ ID NO: 42202 - protein, 10 aa, Artificial Sequence
  Peptide Derived from Human Papillomavirus
WTGRCIACWR

SEQ ID NO: 42203 - protein, 11 aa, Artificial Sequence
  Peptide Derived from Human Papillomavirus
WTGRCIACWRR

SEQ ID NO: 42204 - protein, 10 aa, Artificial Sequence
  Peptide Derived from Human Papillomavirus
YDELRLNCVY

SEQ ID NO: 42205 - protein, 11 aa, Artificial Sequence
  Peptide Derived from Human Papillomavirus
YGTTLEKLTNK

SEQ ID NO: 42206 - protein, 8 aa, Artificial Sequence
  Peptide Derived from Human Papillomavirus
YSKVSEFR

SEQ ID NO: 42207 - protein, 10 aa, Artificial Sequence
  Peptide Derived from Human Papillomavirus
YSKVSEFRWY

SEQ ID NO: 42208 - protein, 11 aa, Artificial Sequence
  Peptide Derived from Human Papillomavirus
YSKVSEFRWYR

SEQ ID NO: 42209 - protein, 10 aa, Artificial Sequence
  Peptide Derived from Human Papillomavirus
YSVYGTTLEK

SEQ ID NO: 42210 - protein, 11 aa, Artificial Sequence
  Peptide Derived from Human Papillomavirus
AGQAEPDTSNY

SEQ ID NO: 42211 - protein, 9 aa, Artificial Sequence
  Peptide Derived from Human Papillomavirus
CCQCKSTLR

SEQ ID NO: 42212 - protein, 10 aa, Artificial Sequence
  Peptide Derived from Human Papillomavirus
CVQSTQVDIR

SEQ ID NO: 42213 - protein, 10 aa, Artificial Sequence
  Peptide Derived from Human Papillomavirus
DLQPEATDLH

SEQ ID NO: 42214 - protein, 8 aa, Artificial Sequence
  Peptide Derived from Human Papillomavirus
EATDLHCY

SEQ ID NO: 42215 - protein, 8 aa, Artificial Sequence
  Peptide Derived from Human Papillomavirus
ETPTLQDY

SEQ ID NO: 42216 - protein, 10 aa, Artificial Sequence
  Peptide Derived from Human Papillomavirus
FCCQCKSTLR

SEQ ID NO: 42217 - protein, 11 aa, Artificial Sequence
  Peptide Derived from Human Papillomavirus
FGIVCPNCSTR

SEQ ID NO: 42218 - protein, 10 aa, Artificial Sequence
  Peptide Derived from Human Papillomavirus
GIVCPNCSTR

SEQ ID NO: 42219 - protein, 9 aa, Artificial Sequence
  Peptide Derived from Human Papillomavirus
IVCPNCSTR

SEQ ID NO: 42220 - protein, 9 aa, Artificial Sequence
  Peptide Derived from Human Papillomavirus
IVTFCCQCK

SEQ ID NO: 42221 - protein, 11 aa, Artificial Sequence
  Peptide Derived from Human Papillomavirus
LCVQSTQVDIR

SEQ ID NO: 42222 - protein, 11 aa, Artificial Sequence
  Peptide Derived from Human Papillomavirus
LDLQPEATDLH

SEQ ID NO: 42223 - protein, 10 aa, Artificial Sequence
  Peptide Derived from Human Papillomavirus
NIVTFCCQCK

SEQ ID NO: 42224 - protein, 9 aa, Artificial Sequence
  Peptide Derived from Human Papillomavirus
QAEPDTSNY

SEQ ID NO: 42225 - protein, 8 aa, Artificial Sequence
  Peptide Derived from Human Papillomavirus
QSTQVDIR

SEQ ID NO: 42226 - protein, 10 aa, Artificial Sequence
  Peptide Derived from Human Papillomavirus
RGETPTLQDY

SEQ ID NO: 42227 - protein, 11 aa, Artificial Sequence
  Peptide Derived from Human Papillomavirus
TFCCQCKSTLR

SEQ ID NO: 42228 - protein, 8 aa, Artificial Sequence
  Peptide Derived from Human Papillomavirus
VCPNCSTR

SEQ ID NO: 42229 - protein, 8 aa, Artificial Sequence
  Peptide Derived from Human Papillomavirus
VTFCCQCK

SEQ ID NO: 42230 - protein, 11 aa, Artificial Sequence
  Peptide Derived from Human Papillomavirus
YNIVTFCCQCK

SEQ ID NO: 42231 - protein, 11 aa, Artificial Sequence
  Peptide Derived from Human Papillomavirus
AAIANSDTTFK

SEQ ID NO: 42232 - protein, 9 aa, Artificial Sequence
  Peptide Derived from Human Papillomavirus
ACVGLEVGR

SEQ ID NO: 42233 - protein, 8 aa, Artificial Sequence
  Peptide Derived from Human Papillomavirus
ADIMTYIH

SEQ ID NO: 42234 - protein, 10 aa, Artificial Sequence
  Peptide Derived from Human Papillomavirus
ADLDQFPLGR

SEQ ID NO: 42235 - protein, 11 aa, Artificial Sequence
  Peptide Derived from Human Papillomavirus
ADLDQFPLGRK

SEQ ID NO: 42236 - protein, 9 aa, Artificial Sequence
  Peptide Derived from Human Papillomavirus
AGGPGTDNR

SEQ ID NO: 42237 - protein, 11 aa, Artificial Sequence
  Peptide Derived from Human Papillomavirus
AGSARLLTVGH

SEQ ID NO: 42238 - protein, 8 aa, Artificial Sequence
  Peptide Derived from Human Papillomavirus
AGYRARPK

SEQ ID NO: 42239 - protein, 10 aa, Artificial Sequence
  Peptide Derived from Human Papillomavirus
AGYRARPKFK

SEQ ID NO: 42240 - protein, 10 aa, Artificial Sequence
  Peptide Derived from Human Papillomavirus
AIANSDTTFK

SEQ ID NO: 42241 - protein, 11 aa, Artificial Sequence
  Peptide Derived from Human Papillomavirus
AITCQKTAPQK

SEQ ID NO: 42242 - protein, 11 aa, Artificial Sequence
  Peptide Derived from Human Papillomavirus
AMDFTALQDTK

SEQ ID NO: 42243 - protein, 8 aa, Artificial Sequence
  Peptide Derived from Human Papillomavirus
ANSDTTFK

SEQ ID NO: 42244 - protein, 8 aa, Artificial Sequence
  Peptide Derived from Human Papillomavirus
ASTTTPAK

SEQ ID NO: 42245 - protein, 9 aa, Artificial Sequence
  Peptide Derived from Human Papillomavirus
ASTTTPAKR

SEQ ID NO: 42246 - protein, 10 aa, Artificial Sequence
  Peptide Derived from Human Papillomavirus
ASTTTPAKRK

SEQ ID NO: 42247 - protein, 11 aa, Artificial Sequence
  Peptide Derived from Human Papillomavirus
ASTTTPAKRKK

SEQ ID NO: 42248 - protein, 8 aa, Artificial Sequence
  Peptide Derived from Human Papillomavirus
ATLANSTY

SEQ ID NO: 42249 - protein, 10 aa, Artificial Sequence
  Peptide Derived from Human Papillomavirus
CNSICKYPDY

SEQ ID NO: 42250 - protein, 8 aa, Artificial Sequence
  Peptide Derived from Human Papillomavirus
CVGLEVGR

SEQ ID NO: 42251 - protein, 9 aa, Artificial Sequence
  Peptide Derived from Human Papillomavirus
DAQIFNKPY

SEQ ID NO: 42252 - protein, 8 aa, Artificial Sequence
  Peptide Derived from Human Papillomavirus
DCPPLELK

SEQ ID NO: 42253 - protein, 8 aa, Artificial Sequence
  Peptide Derived from Human Papillomavirus
DDTENSNR

SEQ ID NO: 42254 - protein, 9 aa, Artificial Sequence
  Peptide Derived from Human Papillomavirus
DDTENSNRY

SEQ ID NO: 42255 - protein, 9 aa, Artificial Sequence
  Peptide Derived from Human Papillomavirus
DFTALQDTK

SEQ ID NO: 42256 - protein, 8 aa, Artificial Sequence
  Peptide Derived from Human Papillomavirus
DICNSICK

SEQ ID NO: 42257 - protein, 9 aa, Artificial Sequence
  Peptide Derived from Human Papillomavirus
DICNSICKY

SEQ ID NO: 42258 - protein, 9 aa, Artificial Sequence
  Peptide Derived from Human Papillomavirus
DLDQFPLGR

SEQ ID NO: 42259 - protein, 10 aa, Artificial Sequence
  Peptide Derived from Human Papillomavirus
DLDQFPLGRK

SEQ ID NO: 42260 - protein, 10 aa, Artificial Sequence
  Peptide Derived from Human Papillomavirus
DLQFIFQLCK

SEQ ID NO: 42261 - protein, 10 aa, Artificial Sequence
  Peptide Derived from Human Papillomavirus
DNPKKIVVPK

SEQ ID NO: 42262 - protein, 10 aa, Artificial Sequence
  Peptide Derived from Human Papillomavirus
DNRECISMDY

SEQ ID NO: 42263 - protein, 11 aa, Artificial Sequence
  Peptide Derived from Human Papillomavirus
DNRECISMDYK

SEQ ID NO: 42264 - protein, 8 aa, Artificial Sequence
  Peptide Derived from Human Papillomavirus
DTENSNRY

SEQ ID NO: 42265 - protein, 8 aa, Artificial Sequence
  Peptide Derived from Human Papillomavirus
DTLFFYLR

SEQ ID NO: 42266 - protein, 9 aa, Artificial Sequence
  Peptide Derived from Human Papillomavirus
DTLFFYLRR

SEQ ID NO: 42267 - protein, 11 aa, Artificial Sequence
  Peptide Derived from Human Papillomavirus
DTSFYNPETQR

SEQ ID NO: 42268 - protein, 10 aa, Artificial Sequence
  Peptide Derived from Human Papillomavirus
DTTFKSSNFK

SEQ ID NO: 42269 - protein, 8 aa, Artificial Sequence
  Peptide Derived from Human Papillomavirus
ECISMDYK

SEQ ID NO: 42270 - protein, 8 aa, Artificial Sequence
  Peptide Derived from Human Papillomavirus
ESVPTDLY

SEQ ID NO: 42271 - protein, 10 aa, Artificial Sequence
  Peptide Derived from Human Papillomavirus
ESVPTDLYIK

SEQ ID NO: 42272 - protein, 9 aa, Artificial Sequence
  Peptide Derived from Human Papillomavirus
FDDTENSNR

SEQ ID NO: 42273 - protein, 10 aa, Artificial Sequence
  Peptide Derived from Human Papillomavirus
FDDTENSNRY

SEQ ID NO: 42274 - protein, 11 aa, Artificial Sequence
  Peptide Derived from Human Papillomavirus
FDLQFIFQLCK

SEQ ID NO: 42275 - protein, 9 aa, Artificial Sequence
  Peptide Derived from Human Papillomavirus
FGFPDTSFY

SEQ ID NO: 42276 - protein, 8 aa, Artificial Sequence
  Peptide Derived from Human Papillomavirus
FLLQAGYR

SEQ ID NO: 42277 - protein, 10 aa, Artificial Sequence
  Peptide Derived from Human Papillomavirus
FLLQAGYRAR

SEQ ID NO: 42278 - protein, 9 aa, Artificial Sequence
  Peptide Derived from Human Papillomavirus
FNKPYWMQR

SEQ ID NO: 42279 - protein, 8 aa, Artificial Sequence
  Peptide Derived from Human Papillomavirus
FTALQDTK

SEQ ID NO: 42280 - protein, 8 aa, Artificial Sequence
  Peptide Derived from Human Papillomavirus
FVRHFFNR

SEQ ID NO: 42281 - protein, 11 aa, Artificial Sequence
  Peptide Derived from Human Papillomavirus
FVTSQAITCQK

SEQ ID NO: 42282 - protein, 9 aa, Artificial Sequence
  Peptide Derived from Human Papillomavirus
FVTVVDTTR

SEQ ID NO: 42283 - protein, 9 aa, Artificial Sequence
  Peptide Derived from Human Papillomavirus
GCKPPIGEH

SEQ ID NO: 42284 - protein, 9 aa, Artificial Sequence
  Peptide Derived from Human Papillomavirus
GDCPPLELK

SEQ ID NO: 42285 - protein, 9 aa, Artificial Sequence
  Peptide Derived from Human Papillomavirus
GDTLFFYLR

SEQ ID NO: 42286 - protein, 10 aa, Artificial Sequence
  Peptide Derived from Human Papillomavirus
GDTLFFYLRR

SEQ ID NO: 42287 - protein, 8 aa, Artificial Sequence
  Peptide Derived from Human Papillomavirus
GFPDTSFY

SEQ ID NO: 42288 - protein, 8 aa, Artificial Sequence
  Peptide Derived from Human Papillomavirus
GGPGTDNR

SEQ ID NO: 42289 - protein, 10 aa, Artificial Sequence
  Peptide Derived from Human Papillomavirus
GISGHPLLNK

SEQ ID NO: 42290 - protein, 8 aa, Artificial Sequence
  Peptide Derived from Human Papillomavirus
GLQYRVFR

SEQ ID NO: 42291 - protein, 10 aa, Artificial Sequence
  Peptide Derived from Human Papillomavirus
GLQYRVFRVR

SEQ ID NO: 42292 - protein, 10 aa, Artificial Sequence
  Peptide Derived from Human Papillomavirus
GSARLLTVGH

SEQ ID NO: 42293 - protein, 8 aa, Artificial Sequence
  Peptide Derived from Human Papillomavirus
GSLEDTYR

SEQ ID NO: 42294 - protein, 11 aa, Artificial Sequence
  Peptide Derived from Human Papillomavirus
GSTATLANSTY

SEQ ID NO: 42295 - protein, 9 aa, Artificial Sequence
  Peptide Derived from Human Papillomavirus
IANSDTTFK

SEQ ID NO: 42296 - protein, 9 aa, Artificial Sequence
  Peptide Derived from Human Papillomavirus
ICKYPDYLK

SEQ ID NO: 42297 - protein, 8 aa, Artificial Sequence
  Peptide Derived from Human Papillomavirus
ICNSICKY

SEQ ID NO: 42298 - protein, 11 aa, Artificial Sequence
  Peptide Derived from Human Papillomavirus
ICNSICKYPDY

SEQ ID NO: 42299 - protein, 10 aa, Artificial Sequence
  Peptide Derived from Human Papillomavirus
IFNKPYWMQR

SEQ ID NO: 42300 - protein, 9 aa, Artificial Sequence
  Peptide Derived from Human Papillomavirus
ISGHPLLNK

SEQ ID NO: 42301 - protein, 10 aa, Artificial Sequence
  Peptide Derived from Human Papillomavirus
ITCQKTAPQK

SEQ ID NO: 42302 - protein, 10 aa, Artificial Sequence
  Peptide Derived from Human Papillomavirus
ITLSADIMTY

SEQ ID NO: 42303 - protein, 11 aa, Artificial Sequence
  Peptide Derived from Human Papillomavirus
IVVPKVSGLQY

SEQ ID NO: 42304 - protein, 11 aa, Artificial Sequence
  Peptide Derived from Human Papillomavirus
KDYVFWEVNLK

SEQ ID NO: 42305 - protein, 10 aa, Artificial Sequence
  Peptide Derived from Human Papillomavirus
KFDDTENSNR

SEQ ID NO: 42306 - protein, 11 aa, Artificial Sequence
  Peptide Derived from Human Papillomavirus
KFDDTENSNRY

SEQ ID NO: 42307 - protein, 10 aa, Artificial Sequence
  Peptide Derived from Human Papillomavirus
KFGFPDTSFY

SEQ ID NO: 42308 - protein, 8 aa, Artificial Sequence
  Peptide Derived from Human Papillomavirus
KFLLQAGY

SEQ ID NO: 42309 - protein, 9 aa, Artificial Sequence
  Peptide Derived from Human Papillomavirus
KFLLQAGYR

SEQ ID NO: 42310 - protein, 11 aa, Artificial Sequence
  Peptide Derived from Human Papillomavirus
KFLLQAGYRAR

SEQ ID NO: 42311 - protein, 11 aa, Artificial Sequence
  Peptide Derived from Human Papillomavirus
KITLSADIMTY

SEQ ID NO: 42312 - protein, 8 aa, Artificial Sequence
  Peptide Derived from Human Papillomavirus
KSSNFKEY

SEQ ID NO: 42313 - protein, 10 aa, Artificial Sequence
  Peptide Derived from Human Papillomavirus
KSSNFKEYLR

SEQ ID NO: 42314 - protein, 11 aa, Artificial Sequence
  Peptide Derived from Human Papillomavirus
KSSNFKEYLRH

SEQ ID NO: 42315 - protein, 8 aa, Artificial Sequence
  Peptide Derived from Human Papillomavirus
KTAPQKPK

SEQ ID NO: 42316 - protein, 8 aa, Artificial Sequence
  Peptide Derived from Human Papillomavirus
KVSGLQYR

SEQ ID NO: 42317 - protein, 11 aa, Artificial Sequence
  Peptide Derived from Human Papillomavirus
KVSGLQYRVFR

SEQ ID NO: 42318 - protein, 8 aa, Artificial Sequence
  Peptide Derived from Human Papillomavirus
KVVSTDEY

SEQ ID NO: 42319 - protein, 11 aa, Artificial Sequence
  Peptide Derived from Human Papillomavirus
KVVSTDEYVTR

SEQ ID NO: 42320 - protein, 9 aa, Artificial Sequence
  Peptide Derived from Human Papillomavirus
LDICNSICK

SEQ ID NO: 42321 - protein, 10 aa, Artificial Sequence
  Peptide Derived from Human Papillomavirus
LDICNSICKY

SEQ ID NO: 42322 - protein, 8 aa, Artificial Sequence
  Peptide Derived from Human Papillomavirus
LDQFPLGR

SEQ ID NO: 42323 - protein, 9 aa, Artificial Sequence
  Peptide Derived from Human Papillomavirus
LDQFPLGRK

SEQ ID NO: 42324 - protein, 10 aa, Artificial Sequence
  Peptide Derived from Human Papillomavirus
LFVTVVDTTR

SEQ ID NO: 42325 - protein, 10 aa, Artificial Sequence
  Peptide Derived from Human Papillomavirus
LGCKPPIGEH

SEQ ID NO: 42326 - protein, 11 aa, Artificial Sequence
  Peptide Derived from Human Papillomavirus
LGRKFLLQAGY

SEQ ID NO: 42327 - protein, 8 aa, Artificial Sequence
  Peptide Derived from Human Papillomavirus
LGVGISGH

SEQ ID NO: 42328 - protein, 11 aa, Artificial Sequence
  Peptide Derived from Human Papillomavirus
LLGCKPPIGEH

SEQ ID NO: 42329 - protein, 9 aa, Artificial Sequence
  Peptide Derived from Human Papillomavirus
LLQAGYRAR

SEQ ID NO: 42330 - protein, 11 aa, Artificial Sequence
  Peptide Derived from Human Papillomavirus
LLQAGYRARPK

SEQ ID NO: 42331 - protein, 8 aa, Artificial Sequence
  Peptide Derived from Human Papillomavirus
LLTVGHPY

SEQ ID NO: 42332 - protein, 9 aa, Artificial Sequence
  Peptide Derived from Human Papillomavirus
LLTVGHPYY

SEQ ID NO: 42333 - protein, 8 aa, Artificial Sequence
  Peptide Derived from Human Papillomavirus
LSADIMTY

SEQ ID NO: 42334 - protein, 10 aa, Artificial Sequence
  Peptide Derived from Human Papillomavirus
LSADIMTYIH

SEQ ID NO: 42335 - protein, 8 aa, Artificial Sequence
  Peptide Derived from Human Papillomavirus
LTVGHPYY

SEQ ID NO: 42336 - protein, 10 aa, Artificial Sequence
  Peptide Derived from Human Papillomavirus
MDFTALQDTK

SEQ ID NO: 42337 - protein, 9 aa, Artificial Sequence
  Peptide Derived from Human Papillomavirus
MFVRHFFNR

SEQ ID NO: 42338 - protein, 11 aa, Artificial Sequence
  Peptide Derived from Human Papillomavirus
MVTSDAQIFNK

SEQ ID NO: 42339 - protein, 8 aa, Artificial Sequence
  Peptide Derived from Human Papillomavirus
NFKEYLRH

SEQ ID NO: 42340 - protein, 10 aa, Artificial Sequence
  Peptide Derived from Human Papillomavirus
NIYYHAGSAR

SEQ ID NO: 42341 - protein, 9 aa, Artificial Sequence
  Peptide Derived from Human Papillomavirus
NSICKYPDY

SEQ ID NO: 42342 - protein, 11 aa, Artificial Sequence
  Peptide Derived from Human Papillomavirus
NSICKYPDYLK

SEQ ID NO: 42343 - protein, 8 aa, Artificial Sequence
  Peptide Derived from Human Papillomavirus
PAKRKKTK

SEQ ID NO: 42344 - protein, 9 aa, Artificial Sequence
  Peptide Derived from Human Papillomavirus
PAKRKKTKK

SEQ ID NO: 42345 - protein, 11 aa, Artificial Sequence
  Peptide Derived from Human Papillomavirus
PDYLKMVAEPY

SEQ ID NO: 42346 - protein, 10 aa, Artificial Sequence
  Peptide Derived from Human Papillomavirus
PGDCPPLELK

SEQ ID NO: 42347 - protein, 8 aa, Artificial Sequence
  Peptide Derived from Human Papillomavirus
PIGEHWGK

SEQ ID NO: 42348 - protein, 10 aa, Artificial Sequence
  Peptide Derived from Human Papillomavirus
PLDICNSICK

SEQ ID NO: 42349 - protein, 11 aa, Artificial Sequence
  Peptide Derived from Human Papillomavirus
PLDICNSICKY

SEQ ID NO: 42350 - protein, 9 aa, Artificial Sequence
  Peptide Derived from Human Papillomavirus
PLGVGISGH

SEQ ID NO: 42351 - protein, 10 aa, Artificial Sequence
  Peptide Derived from Human Papillomavirus
PSASTTTPAK

SEQ ID NO: 42352 - protein, 11 aa, Artificial Sequence
  Peptide Derived from Human Papillomavirus
PSASTTTPAKR

SEQ ID NO: 42353 - protein, 9 aa, Artificial Sequence
  Peptide Derived from Human Papillomavirus
PSGSLEDTY

SEQ ID NO: 42354 - protein, 10 aa, Artificial Sequence
  Peptide Derived from Human Papillomavirus
PSGSLEDTYR

SEQ ID NO: 42355 - protein, 11 aa, Artificial Sequence
  Peptide Derived from Human Papillomavirus
PVSKVVSTDEY

SEQ ID NO: 42356 - protein, 9 aa, Artificial Sequence
  Peptide Derived from Human Papillomavirus
QAGYRARPK

SEQ ID NO: 42357 - protein, 11 aa, Artificial Sequence
  Peptide Derived from Human Papillomavirus
QAGYRARPKFK

SEQ ID NO: 42358 - protein, 8 aa, Artificial Sequence
  Peptide Derived from Human Papillomavirus
QFIFQLCK

SEQ ID NO: 42359 - protein, 11 aa, Artificial Sequence
  Peptide Derived from Human Papillomavirus
QIFNKPYWMQR

SEQ ID NO: 42360 - protein, 8 aa, Artificial Sequence
  Peptide Derived from Human Papillomavirus
QLCLLGCK

SEQ ID NO: 42361 - protein, 11 aa, Artificial Sequence
  Peptide Derived from Human Papillomavirus
QLFVTVVDTTR

SEQ ID NO: 42362 - protein, 10 aa, Artificial Sequence
  Peptide Derived from Human Papillomavirus
QMFVRHFFNR

SEQ ID NO: 42363 - protein, 10 aa, Artificial Sequence
  Peptide Derived from Human Papillomavirus
QTQLCLLGCK

SEQ ID NO: 42364 - protein, 10 aa, Artificial Sequence
  Peptide Derived from Human Papillomavirus
RARPKFKAGK

SEQ ID NO: 42365 - protein, 11 aa, Artificial Sequence
  Peptide Derived from Human Papillomavirus
RARPKFKAGKR

SEQ ID NO: 42366 - protein, 9 aa, Artificial Sequence
  Peptide Derived from Human Papillomavirus
RLLTVGHPY

SEQ ID NO: 42367 - protein, 10 aa, Artificial Sequence
  Peptide Derived from Human Papillomavirus
RLLTVGHPYY

SEQ ID NO: 42368 - protein, 9 aa, Artificial Sequence
  Peptide Derived from Human Papillomavirus
RVRLPDPNK

SEQ ID NO: 42369 - protein, 9 aa, Artificial Sequence
  Peptide Derived from Human Papillomavirus
SADIMTYIH

SEQ ID NO: 42370 - protein, 11 aa, Artificial Sequence
  Peptide Derived from Human Papillomavirus
SADLDQFPLGR

SEQ ID NO: 42371 - protein, 9 aa, Artificial Sequence
  Peptide Derived from Human Papillomavirus
SARLLTVGH

SEQ ID NO: 42372 - protein, 11 aa, Artificial Sequence
  Peptide Derived from Human Papillomavirus
SARLLTVGHPY

SEQ ID NO: 42373 - protein, 9 aa, Artificial Sequence
  Peptide Derived from Human Papillomavirus
SASTTTPAK

SEQ ID NO: 42374 - protein, 10 aa, Artificial Sequence
  Peptide Derived from Human Papillomavirus
SASTTTPAKR

SEQ ID NO: 42375 - protein, 11 aa, Artificial Sequence
  Peptide Derived from Human Papillomavirus
SASTTTPAKRK

SEQ ID NO: 42376 - protein, 8 aa, Artificial Sequence
  Peptide Derived from Human Papillomavirus
SDAQIFNK

SEQ ID NO: 42377 - protein, 10 aa, Artificial Sequence
  Peptide Derived from Human Papillomavirus
SDAQIFNKPY

SEQ ID NO: 42378 - protein, 11 aa, Artificial Sequence
  Peptide Derived from Human Papillomavirus
SDNPKKIVVPK

SEQ ID NO: 42379 - protein, 11 aa, Artificial Sequence
  Peptide Derived from Human Papillomavirus
SDTTFKSSNFK

SEQ ID NO: 42380 - protein, 9 aa, Artificial Sequence
  Peptide Derived from Human Papillomavirus
SFYNPETQR

SEQ ID NO: 42381 - protein, 8 aa, Artificial Sequence
  Peptide Derived from Human Papillomavirus
SGHPLLNK

SEQ ID NO: 42382 - protein, 9 aa, Artificial Sequence
  Peptide Derived from Human Papillomavirus
SGLQYRVFR

SEQ ID NO: 42383 - protein, 11 aa, Artificial Sequence
  Peptide Derived from Human Papillomavirus
SGLQYRVFRVR

SEQ ID NO: 42384 - protein, 8 aa, Artificial Sequence
  Peptide Derived from Human Papillomavirus
SGSLEDTY

SEQ ID NO: 42385 - protein, 9 aa, Artificial Sequence
  Peptide Derived from Human Papillomavirus
SGSLEDTYR

SEQ ID NO: 42386 - protein, 8 aa, Artificial Sequence
  Peptide Derived from Human Papillomavirus
SICKYPDY

SEQ ID NO: 42387 - protein, 10 aa, Artificial Sequence
  Peptide Derived from Human Papillomavirus
SICKYPDYLK

SEQ ID NO: 42388 - protein, 9 aa, Artificial Sequence
  Peptide Derived from Human Papillomavirus
SIPKSDNPK

SEQ ID NO: 42389 - protein, 10 aa, Artificial Sequence
  Peptide Derived from Human Papillomavirus
SIPKSDNPKK

SEQ ID NO: 42390 - protein, 11 aa, Artificial Sequence
  Peptide Derived from Human Papillomavirus
SLWRPSEATVY

SEQ ID NO: 42391 - protein, 8 aa, Artificial Sequence
  Peptide Derived from Human Papillomavirus
SNFKEYLR

SEQ ID NO: 42392 - protein, 9 aa, Artificial Sequence
  Peptide Derived from Human Papillomavirus
SNFKEYLRH

SEQ ID NO: 42393 - protein, 9 aa, Artificial Sequence
  Peptide Derived from Human Papillomavirus
SSNFKEYLR

SEQ ID NO: 42394 - protein, 10 aa, Artificial Sequence
  Peptide Derived from Human Papillomavirus
SSNFKEYLRH

SEQ ID NO: 42395 - protein, 10 aa, Artificial Sequence
  Peptide Derived from Human Papillomavirus
STATLANSTY

SEQ ID NO: 42396 - protein, 8 aa, Artificial Sequence
  Peptide Derived from Human Papillomavirus
STDEYVTR

SEQ ID NO: 42397 - protein, 8 aa, Artificial Sequence
  Peptide Derived from Human Papillomavirus
STTTPAKR

SEQ ID NO: 42398 - protein, 9 aa, Artificial Sequence
  Peptide Derived from Human Papillomavirus
STTTPAKRK

SEQ ID NO: 42399 - protein, 10 aa, Artificial Sequence
  Peptide Derived from Human Papillomavirus
STTTPAKRKK

SEQ ID NO: 42400 - protein, 9 aa, Artificial Sequence
  Peptide Derived from Human Papillomavirus
SVPTDLYIK

SEQ ID NO: 42401 - protein, 9 aa, Artificial Sequence
  Peptide Derived from Human Papillomavirus
TATLANSTY

SEQ ID NO: 42402 - protein, 9 aa, Artificial Sequence
  Peptide Derived from Human Papillomavirus
TCQKTAPQK

SEQ ID NO: 42403 - protein, 11 aa, Artificial Sequence
  Peptide Derived from Human Papillomavirus
TCQKTAPQKPK

SEQ ID NO: 42404 - protein, 11 aa, Artificial Sequence
  Peptide Derived from Human Papillomavirus
TDEYVTRTNIY

SEQ ID NO: 42405 - protein, 11 aa, Artificial Sequence
  Peptide Derived from Human Papillomavirus
TDNRECISMDY

SEQ ID NO: 42406 - protein, 8 aa, Artificial Sequence
  Peptide Derived from Human Papillomavirus
TFKSSNFK

SEQ ID NO: 42407 - protein, 10 aa, Artificial Sequence
  Peptide Derived from Human Papillomavirus
TFKSSNFKEY

SEQ ID NO: 42408 - protein, 8 aa, Artificial Sequence
  Peptide Derived from Human Papillomavirus
TLFFYLRR

SEQ ID NO: 42409 - protein, 9 aa, Artificial Sequence
  Peptide Derived from Human Papillomavirus
TLSADIMTY

SEQ ID NO: 42410 - protein, 11 aa, Artificial Sequence
  Peptide Derived from Human Papillomavirus
TLSADIMTYIH

SEQ ID NO: 42411 - protein, 11 aa, Artificial Sequence
  Peptide Derived from Human Papillomavirus
TNIYYHAGSAR

SEQ ID NO: 42412 - protein, 9 aa, Artificial Sequence
  Peptide Derived from Human Papillomavirus
TSDAQIFNK

SEQ ID NO: 42413 - protein, 11 aa, Artificial Sequence
  Peptide Derived from Human Papillomavirus
TSDAQIFNKPY

SEQ ID NO: 42414 - protein, 10 aa, Artificial Sequence
  Peptide Derived from Human Papillomavirus
TSFYNPETQR

SEQ ID NO: 42415 - protein, 9 aa, Artificial Sequence
  Peptide Derived from Human Papillomavirus
TSQAITCQK

SEQ ID NO: 42416 - protein, 9 aa, Artificial Sequence
  Peptide Derived from Human Papillomavirus
TTFKSSNFK

SEQ ID NO: 42417 - protein, 11 aa, Artificial Sequence
  Peptide Derived from Human Papillomavirus
TTFKSSNFKEY

SEQ ID NO: 42418 - protein, 8 aa, Artificial Sequence
  Peptide Derived from Human Papillomavirus
TTPAKRKK

SEQ ID NO: 42419 - protein, 10 aa, Artificial Sequence
  Peptide Derived from Human Papillomavirus
TTPAKRKKTK

SEQ ID NO: 42420 - protein, 11 aa, Artificial Sequence
  Peptide Derived from Human Papillomavirus
TTPAKRKKTKK

SEQ ID NO: 42421 - protein, 8 aa, Artificial Sequence
  Peptide Derived from Human Papillomavirus
TTTPAKRK

SEQ ID NO: 42422 - protein, 9 aa, Artificial Sequence
  Peptide Derived from Human Papillomavirus
TTTPAKRKK

SEQ ID NO: 42423 - protein, 11 aa, Artificial Sequence
  Peptide Derived from Human Papillomavirus
TTTPAKRKKTK

SEQ ID NO: 42424 - protein, 11 aa, Artificial Sequence
  Peptide Derived from Human Papillomavirus
TVGESVPTDLY

SEQ ID NO: 42425 - protein, 11 aa, Artificial Sequence
  Peptide Derived from Human Papillomavirus
TVGHPYYSIPK

SEQ ID NO: 42426 - protein, 11 aa, Artificial Sequence
  Peptide Derived from Human Papillomavirus
TVYLPPVPVSK

SEQ ID NO: 42427 - protein, 11 aa, Artificial Sequence
  Peptide Derived from Human Papillomavirus
VFRVRLPDPNK

SEQ ID NO: 42428 - protein, 8 aa, Artificial Sequence
  Peptide Derived from Human Papillomavirus
VFWEVNLK

SEQ ID NO: 42429 - protein, 10 aa, Artificial Sequence
  Peptide Derived from Human Papillomavirus
VFWEVNLKEK

SEQ ID NO: 42430 - protein, 10 aa, Artificial Sequence
  Peptide Derived from Human Papillomavirus
VGESVPTDLY

SEQ ID NO: 42431 - protein, 10 aa, Artificial Sequence
  Peptide Derived from Human Papillomavirus
VGHPYYSIPK

SEQ ID NO: 42432 - protein, 11 aa, Artificial Sequence
  Peptide Derived from Human Papillomavirus
VGISGHPLLNK

SEQ ID NO: 42433 - protein, 10 aa, Artificial Sequence
  Peptide Derived from Human Papillomavirus
VSGLQYRVFR

SEQ ID NO: 42434 - protein, 10 aa, Artificial Sequence
  Peptide Derived from Human Papillomavirus
VSKVVSTDEY

SEQ ID NO: 42435 - protein, 9 aa, Artificial Sequence
  Peptide Derived from Human Papillomavirus
VSTDEYVTR

SEQ ID NO: 42436 - protein, 8 aa, Artificial Sequence
  Peptide Derived from Human Papillomavirus
VTRTNIYY

SEQ ID NO: 42437 - protein, 9 aa, Artificial Sequence
  Peptide Derived from Human Papillomavirus
VTRTNIYYH

SEQ ID NO: 42438 - protein, 10 aa, Artificial Sequence
  Peptide Derived from Human Papillomavirus
VTSDAQIFNK

SEQ ID NO: 42439 - protein, 10 aa, Artificial Sequence
  Peptide Derived from Human Papillomavirus
VTSQAITCQK

SEQ ID NO: 42440 - protein, 8 aa, Artificial Sequence
  Peptide Derived from Human Papillomavirus
VTVVDTTR

SEQ ID NO: 42441 - protein, 10 aa, Artificial Sequence
  Peptide Derived from Human Papillomavirus
VVPKVSGLQY

SEQ ID NO: 42442 - protein, 11 aa, Artificial Sequence
  Peptide Derived from Human Papillomavirus
VVPKVSGLQYR

SEQ ID NO: 42443 - protein, 10 aa, Artificial Sequence
  Peptide Derived from Human Papillomavirus
VVSTDEYVTR

SEQ ID NO: 42444 - protein, 10 aa, Artificial Sequence
  Peptide Derived from Human Papillomavirus
WACVGLEVGR

SEQ ID NO: 42445 - protein, 8 aa, Artificial Sequence
  Peptide Derived from Human Papillomavirus
WMQRAQGH

SEQ ID NO: 42446 - protein, 10 aa, Artificial Sequence
  Peptide Derived from Human Papillomavirus
YAGGPGTDNR

SEQ ID NO: 42447 - protein, 8 aa, Artificial Sequence
  Peptide Derived from Human Papillomavirus
YGDTLFFY

SEQ ID NO: 42448 - protein, 10 aa, Artificial Sequence
  Peptide Derived from Human Papillomavirus
YGDTLFFYLR

SEQ ID NO: 42449 - protein, 11 aa, Artificial Sequence
  Peptide Derived from Human Papillomavirus
YGDTLFFYLRR

SEQ ID NO: 42450 - protein, 9 aa, Artificial Sequence
  Peptide Derived from Human Papillomavirus
YLKMVAEPY

SEQ ID NO: 42451 - protein, 9 aa, Artificial Sequence
  Peptide Derived from Human Papillomavirus
YLPPVPVSK

SEQ ID NO: 42452 - protein, 10 aa, Artificial Sequence
  Peptide Derived from Human Papillomavirus
YLRREQMFVR

SEQ ID NO: 42453 - protein, 11 aa, Artificial Sequence
  Peptide Derived from Human Papillomavirus
YLRREQMFVRH

SEQ ID NO: 42454 - protein, 10 aa, Artificial Sequence
  Peptide Derived from Human Papillomavirus
YSIPKSDNPK

SEQ ID NO: 42455 - protein, 11 aa, Artificial Sequence
  Peptide Derived from Human Papillomavirus
YSIPKSDNPKK

SEQ ID NO: 42456 - protein, 9 aa, Artificial Sequence
  Peptide Derived from Human Papillomavirus
YVFWEVNLK

SEQ ID NO: 42457 - protein, 11 aa, Artificial Sequence
  Peptide Derived from Human Papillomavirus
YVFWEVNLKEK

SEQ ID NO: 42458 - protein, 8 aa, Artificial Sequence
  Peptide Derived from Human Papillomavirus
YVTRTNIY

SEQ ID NO: 42459 - protein, 9 aa, Artificial Sequence
  Peptide Derived from Human Papillomavirus
YVTRTNIYY

SEQ ID NO: 42460 - protein, 10 aa, Artificial Sequence
  Peptide Derived from Human Papillomavirus
YVTRTNIYYH

SEQ ID NO: 42461 - protein, 11 aa, Artificial Sequence
  Peptide Derived from Human Papillomavirus
AGTCPSDVIPK

SEQ ID NO: 42462 - protein, 11 aa, Artificial Sequence
  Peptide Derived from Human Papillomavirus
AILDVTSVSTH

SEQ ID NO: 42463 - protein, 10 aa, Artificial Sequence
  Peptide Derived from Human Papillomavirus
ALHRPALTSR

SEQ ID NO: 42464 - protein, 11 aa, Artificial Sequence
  Peptide Derived from Human Papillomavirus
ALHRPALTSRR

SEQ ID NO: 42465 - protein, 10 aa, Artificial Sequence
  Peptide Derived from Human Papillomavirus
ALTSRRNTVR

SEQ ID NO: 42466 - protein, 11 aa, Artificial Sequence
  Peptide Derived from Human Papillomavirus
ALTSRRNTVRY

SEQ ID NO: 42467 - protein, 11 aa, Artificial Sequence
  Peptide Derived from Human Papillomavirus
ASATQLYQTCK

SEQ ID NO: 42468 - protein, 8 aa, Artificial Sequence
  Peptide Derived from Human Papillomavirus
ATIGARVH

SEQ ID NO: 42469 - protein, 9 aa, Artificial Sequence
  Peptide Derived from Human Papillomavirus
ATIGARVHY

SEQ ID NO: 42470 - protein, 10 aa, Artificial Sequence
  Peptide Derived from Human Papillomavirus
ATIGARVHYY

SEQ ID NO: 42471 - protein, 11 aa, Artificial Sequence
  Peptide Derived from Human Papillomavirus
ATIGARVHYYY

SEQ ID NO: 42472 - protein, 9 aa, Artificial Sequence
  Peptide Derived from Human Papillomavirus
ATQLYQTCK

SEQ ID NO: 42473 - protein, 11 aa, Artificial Sequence
  Peptide Derived from Human Papillomavirus
AVQSTSAVSAY

SEQ ID NO: 42474 - protein, 9 aa, Artificial Sequence
  Peptide Derived from Human Papillomavirus
DFLDIIALH

SEQ ID NO: 42475 - protein, 10 aa, Artificial Sequence
  Peptide Derived from Human Papillomavirus
DFLDIIALHR

SEQ ID NO: 42476 - protein, 10 aa, Artificial Sequence
  Peptide Derived from Human Papillomavirus
DFTVDTPATH

SEQ ID NO: 42477 - protein, 8 aa, Artificial Sequence
  Peptide Derived from Human Papillomavirus
DFYLHPSY

SEQ ID NO: 42478 - protein, 9 aa, Artificial Sequence
  Peptide Derived from Human Papillomavirus
DFYLHPSYY

SEQ ID NO: 42479 - protein, 8 aa, Artificial Sequence
  Peptide Derived from Human Papillomavirus
DGGDFYLH

SEQ ID NO: 42480 - protein, 11 aa, Artificial Sequence
  Peptide Derived from Human Papillomavirus
DGGDFYLHPSY

SEQ ID NO: 42481 - protein, 10 aa, Artificial Sequence
  Peptide Derived from Human Papillomavirus
DVGAPAPIPH

SEQ ID NO: 42482 - protein, 8 aa, Artificial Sequence
  Peptide Derived from Human Papillomavirus
DVIPKIEH

SEQ ID NO: 42483 - protein, 8 aa, Artificial Sequence
  Peptide Derived from Human Papillomavirus
DVTSVSTH

SEQ ID NO: 42484 - protein, 10 aa, Artificial Sequence
  Peptide Derived from Human Papillomavirus
ESLYFSNTSH

SEQ ID NO: 42485 - protein, 10 aa, Artificial Sequence
  Peptide Derived from Human Papillomavirus
ETVNAEESLY

SEQ ID NO: 42486 - protein, 8 aa, Artificial Sequence
  Peptide Derived from Human Papillomavirus
FLDIIALH

SEQ ID NO: 42487 - protein, 9 aa, Artificial Sequence
  Peptide Derived from Human Papillomavirus
FLDIIALHR

SEQ ID NO: 42488 - protein, 11 aa, Artificial Sequence
  Peptide Derived from Human Papillomavirus
FLSAPKQLITY

SEQ ID NO: 42489 - protein, 10 aa, Artificial Sequence
  Peptide Derived from Human Papillomavirus
FSGPDVPIEH

SEQ ID NO: 42490 - protein, 9 aa, Artificial Sequence
  Peptide Derived from Human Papillomavirus
FTVDTPATH

SEQ ID NO: 42491 - protein, 8 aa, Artificial Sequence
  Peptide Derived from Human Papillomavirus
FVDGGDFY

SEQ ID NO: 42492 - protein, 10 aa, Artificial Sequence
  Peptide Derived from Human Papillomavirus
FVDGGDFYLH

SEQ ID NO: 42493 - protein, 8 aa, Artificial Sequence
  Peptide Derived from Human Papillomavirus
GAPAPIPH

SEQ ID NO: 42494 - protein, 8 aa, Artificial Sequence
  Peptide Derived from Human Papillomavirus
GARVHYYY

SEQ ID NO: 42495 - protein, 9 aa, Artificial Sequence
  Peptide Derived from Human Papillomavirus
GATIGARVH

SEQ ID NO: 42496 - protein, 10 aa, Artificial Sequence
  Peptide Derived from Human Papillomavirus
GATIGARVHY

SEQ ID NO: 42497 - protein, 11 aa, Artificial Sequence
  Peptide Derived from Human Papillomavirus
GATIGARVHYY

SEQ ID NO: 42498 - protein, 9 aa, Artificial Sequence
  Peptide Derived from Human Papillomavirus
GDFYLHPSY

SEQ ID NO: 42499 - protein, 10 aa, Artificial Sequence
  Peptide Derived from Human Papillomavirus
GDFYLHPSYY

SEQ ID NO: 42500 - protein, 10 aa, Artificial Sequence
  Peptide Derived from Human Papillomavirus
GGDFYLHPSY

SEQ ID NO: 42501 - protein, 11 aa, Artificial Sequence
  Peptide Derived from Human Papillomavirus
GGDFYLHPSYY

SEQ ID NO: 42502 - protein, 11 aa, Artificial Sequence
  Peptide Derived from Human Papillomavirus
GIGSGSGTGGR

SEQ ID NO: 42503 - protein, 11 aa, Artificial Sequence
  Peptide Derived from Human Papillomavirus
GLYSKATQQVK

SEQ ID NO: 42504 - protein, 9 aa, Artificial Sequence
  Peptide Derived from Human Papillomavirus
GNKQTLRTR

SEQ ID NO: 42505 - protein, 9 aa, Artificial Sequence
  Peptide Derived from Human Papillomavirus
GSGSGTGGR

SEQ ID NO: 42506 - protein, 10 aa, Artificial Sequence
  Peptide Derived from Human Papillomavirus
GSGTGGRTGY

SEQ ID NO: 42507 - protein, 10 aa, Artificial Sequence
  Peptide Derived from Human Papillomavirus
GTCPSDVIPK

SEQ ID NO: 42508 - protein, 8 aa, Artificial Sequence
  Peptide Derived from Human Papillomavirus
GTGGRTGY

SEQ ID NO: 42509 - protein, 11 aa, Artificial Sequence
  Peptide Derived from Human Papillomavirus
GVRRPARLGLY

SEQ ID NO: 42510 - protein, 10 aa, Artificial Sequence
  Peptide Derived from Human Papillomavirus
HTTIADQILR

SEQ ID NO: 42511 - protein, 11 aa, Artificial Sequence
  Peptide Derived from Human Papillomavirus
HTTIADQILRY

SEQ ID NO: 42512 - protein, 8 aa, Artificial Sequence
  Peptide Derived from Human Papillomavirus
IADQILRY

SEQ ID NO: 42513 - protein, 11 aa, Artificial Sequence
  Peptide Derived from Human Papillomavirus
IALHRPALTSR

SEQ ID NO: 42514 - protein, 10 aa, Artificial Sequence
  Peptide Derived from Human Papillomavirus
IDPTFLSAPK

SEQ ID NO: 42515 - protein, 11 aa, Artificial Sequence
  Peptide Derived from Human Papillomavirus
IFSGPDVPIEH

SEQ ID NO: 42516 - protein, 9 aa, Artificial Sequence
  Peptide Derived from Human Papillomavirus
IFVDGGDFY

SEQ ID NO: 42517 - protein, 11 aa, Artificial Sequence
  Peptide Derived from Human Papillomavirus
IFVDGGDFYLH

SEQ ID NO: 42518 - protein, 8 aa, Artificial Sequence
  Peptide Derived from Human Papillomavirus
IGARVHYY

SEQ ID NO: 42519 - protein, 9 aa, Artificial Sequence
  Peptide Derived from Human Papillomavirus
IGARVHYYY

SEQ ID NO: 42520 - protein, 10 aa, Artificial Sequence
  Peptide Derived from Human Papillomavirus
IGSGSGTGGR

SEQ ID NO: 42521 - protein, 10 aa, Artificial Sequence
  Peptide Derived from Human Papillomavirus
ILDVTSVSTH

SEQ ID NO: 42522 - protein, 11 aa, Artificial Sequence
  Peptide Derived from Human Papillomavirus
ITSSTPIPGVR

SEQ ID NO: 42523 - protein, 8 aa, Artificial Sequence
  Peptide Derived from Human Papillomavirus
ITYENPAY

SEQ ID NO: 42524 - protein, 8 aa, Artificial Sequence
  Peptide Derived from Human Papillomavirus
LDIIALHR

SEQ ID NO: 42525 - protein, 9 aa, Artificial Sequence
  Peptide Derived from Human Papillomavirus
LDVTSVSTH

SEQ ID NO: 42526 - protein, 8 aa, Artificial Sequence
  Peptide Derived from Human Papillomavirus
LGNKQTLR

SEQ ID NO: 42527 - protein, 10 aa, Artificial Sequence
  Peptide Derived from Human Papillomavirus
LGNKQTLRTR

SEQ ID NO: 42528 - protein, 9 aa, Artificial Sequence
  Peptide Derived from Human Papillomavirus
LITYENPAY

SEQ ID NO: 42529 - protein, 11 aa, Artificial Sequence
  Peptide Derived from Human Papillomavirus
LLLSSSSISTH

SEQ ID NO: 42530 - protein, 10 aa, Artificial Sequence
  Peptide Derived from Human Papillomavirus
LLSSSSISTH

SEQ ID NO: 42531 - protein, 9 aa, Artificial Sequence
  Peptide Derived from Human Papillomavirus
LNDGLYDIY

SEQ ID NO: 42532 - protein, 10 aa, Artificial Sequence
  Peptide Derived from Human Papillomavirus
LSAPKQLITY

SEQ ID NO: 42533 - protein, 9 aa, Artificial Sequence
  Peptide Derived from Human Papillomavirus
LSSSSISTH

SEQ ID NO: 42534 - protein, 11 aa, Artificial Sequence
  Peptide Derived from Human Papillomavirus
LSSSSISTHNY

SEQ ID NO: 42535 - protein, 9 aa, Artificial Sequence
  Peptide Derived from Human Papillomavirus
LTSRRNTVR

SEQ ID NO: 42536 - protein, 10 aa, Artificial Sequence
  Peptide Derived from Human Papillomavirus
LTSRRNTVRY

SEQ ID NO: 42537 - protein, 8 aa, Artificial Sequence
  Peptide Derived from Human Papillomavirus
MLKRRRKR

SEQ ID NO: 42538 - protein, 11 aa, Artificial Sequence
  Peptide Derived from Human Papillomavirus
MLKRRRKRVSY

SEQ ID NO: 42539 - protein, 8 aa, Artificial Sequence
  Peptide Derived from Human Papillomavirus
NDGLYDIY

SEQ ID NO: 42540 - protein, 11 aa, Artificial Sequence
  Peptide Derived from Human Papillomavirus
NTVRYSRLGNK

SEQ ID NO: 42541 - protein, 11 aa, Artificial Sequence
  Peptide Derived from Human Papillomavirus
PALTSRRNTVR

SEQ ID NO: 42542 - protein, 9 aa, Artificial Sequence
  Peptide Derived from Human Papillomavirus
PARLGLYSK

SEQ ID NO: 42543 - protein, 10 aa, Artificial Sequence
  Peptide Derived from Human Papillomavirus
PDFLDIIALH

SEQ ID NO: 42544 - protein, 11 aa, Artificial Sequence
  Peptide Derived from Human Papillomavirus
PDFLDIIALHR

SEQ ID NO: 42545 - protein, 8 aa, Artificial Sequence
  Peptide Derived from Human Papillomavirus
PGVRRPAR

SEQ ID NO: 42546 - protein, 10 aa, Artificial Sequence
  Peptide Derived from Human Papillomavirus
PIPGVRRPAR

SEQ ID NO: 42547 - protein, 10 aa, Artificial Sequence
  Peptide Derived from Human Papillomavirus
PSDVIPKIEH

SEQ ID NO: 42548 - protein, 8 aa, Artificial Sequence
  Peptide Derived from Human Papillomavirus
PSYYMLKR

SEQ ID NO: 42549 - protein, 9 aa, Artificial Sequence
  Peptide Derived from Human Papillomavirus
PSYYMLKRR

SEQ ID NO: 42550 - protein, 10 aa, Artificial Sequence
  Peptide Derived from Human Papillomavirus
PSYYMLKRRR

SEQ ID NO: 42551 - protein, 11 aa, Artificial Sequence
  Peptide Derived from Human Papillomavirus
PSYYMLKRRRK

SEQ ID NO: 42552 - protein, 8 aa, Artificial Sequence
  Peptide Derived from Human Papillomavirus
PTFLSAPK

SEQ ID NO: 42553 - protein, 9 aa, Artificial Sequence
  Peptide Derived from Human Papillomavirus
PTPAETSGH

SEQ ID NO: 42554 - protein, 10 aa, Artificial Sequence
  Peptide Derived from Human Papillomavirus
QLITYENPAY

SEQ ID NO: 42555 - protein, 9 aa, Artificial Sequence
  Peptide Derived from Human Papillomavirus
QSTSAVSAY

SEQ ID NO: 42556 - protein, 8 aa, Artificial Sequence
  Peptide Derived from Human Papillomavirus
RASATQLY

SEQ ID NO: 42557 - protein, 9 aa, Artificial Sequence
  Peptide Derived from Human Papillomavirus
RLGNKQTLR

SEQ ID NO: 42558 - protein, 11 aa, Artificial Sequence
  Peptide Derived from Human Papillomavirus
RLGNKQTLRTR

SEQ ID NO: 42559 - protein, 8 aa, Artificial Sequence
  Peptide Derived from Human Papillomavirus
RNTVRYSR

SEQ ID NO: 42560 - protein, 9 aa, Artificial Sequence
  Peptide Derived from Human Papillomavirus
RSGATIGAR

SEQ ID NO: 42561 - protein, 11 aa, Artificial Sequence
  Peptide Derived from Human Papillomavirus
RSGATIGARVH

SEQ ID NO: 42562 - protein, 8 aa, Artificial Sequence
  Peptide Derived from Human Papillomavirus
RSKRSTKR

SEQ ID NO: 42563 - protein, 10 aa, Artificial Sequence
  Peptide Derived from Human Papillomavirus
RSKRSTKRTK

SEQ ID NO: 42564 - protein, 11 aa, Artificial Sequence
  Peptide Derived from Human Papillomavirus
RSKRSTKRTKR

SEQ ID NO: 42565 - protein, 8 aa, Artificial Sequence
  Peptide Derived from Human Papillomavirus
RSTKRTKR

SEQ ID NO: 42566 - protein, 10 aa, Artificial Sequence
  Peptide Derived from Human Papillomavirus
RTGYVPLSTR

SEQ ID NO: 42567 - protein, 11 aa, Artificial Sequence
  Peptide Derived from Human Papillomavirus
RTKRASATQLY

SEQ ID NO: 42568 - protein, 11 aa, Artificial Sequence
  Peptide Derived from Human Papillomavirus
RTRSGATIGAR

SEQ ID NO: 42569 - protein, 9 aa, Artificial Sequence
  Peptide Derived from Human Papillomavirus
SAPKQLITY

SEQ ID NO: 42570 - protein, 10 aa, Artificial Sequence
  Peptide Derived from Human Papillomavirus
SATQLYQTCK

SEQ ID NO: 42571 - protein, 9 aa, Artificial Sequence
  Peptide Derived from Human Papillomavirus
SDVIPKIEH

SEQ ID NO: 42572 - protein, 8 aa, Artificial Sequence
  Peptide Derived from Human Papillomavirus
SGATIGAR

SEQ ID NO: 42573 - protein, 10 aa, Artificial Sequence
  Peptide Derived from Human Papillomavirus
SGATIGARVH

SEQ ID NO: 42574 - protein, 11 aa, Artificial Sequence
  Peptide Derived from Human Papillomavirus
SGATIGARVHY

SEQ ID NO: 42575 - protein, 9 aa, Artificial Sequence
  Peptide Derived from Human Papillomavirus
SGPDVPIEH

SEQ ID NO: 42576 - protein, 8 aa, Artificial Sequence
  Peptide Derived from Human Papillomavirus
SGSGTGGR

SEQ ID NO: 42577 - protein, 11 aa, Artificial Sequence
  Peptide Derived from Human Papillomavirus
SGSGTGGRTGY

SEQ ID NO: 42578 - protein, 9 aa, Artificial Sequence
  Peptide Derived from Human Papillomavirus
SGTGGRTGY

SEQ ID NO: 42579 - protein, 10 aa, Artificial Sequence
  Peptide Derived from Human Papillomavirus
SIFVDGGDFY

SEQ ID NO: 42580 - protein, 9 aa, Artificial Sequence
  Peptide Derived from Human Papillomavirus
SLYFSNTSH

SEQ ID NO: 42581 - protein, 8 aa, Artificial Sequence
  Peptide Derived from Human Papillomavirus
SSISTHNY

SEQ ID NO: 42582 - protein, 9 aa, Artificial Sequence
  Peptide Derived from Human Papillomavirus
SSSISTHNY

SEQ ID NO: 42583 - protein, 8 aa, Artificial Sequence
  Peptide Derived from Human Papillomavirus
SSSSISTH

SEQ ID NO: 42584 - protein, 10 aa, Artificial Sequence
  Peptide Derived from Human Papillomavirus
SSSSISTHNY

SEQ ID NO: 42585 - protein, 9 aa, Artificial Sequence
  Peptide Derived from Human Papillomavirus
SSTPIPGVR

SEQ ID NO: 42586 - protein, 10 aa, Artificial Sequence
  Peptide Derived from Human Papillomavirus
SSTPIPGVRR

SEQ ID NO: 42587 - protein, 8 aa, Artificial Sequence
  Peptide Derived from Human Papillomavirus
STLNDGLY

SEQ ID NO: 42588 - protein, 11 aa, Artificial Sequence
  Peptide Derived from Human Papillomavirus
STLNDGLYDIY

SEQ ID NO: 42589 - protein, 8 aa, Artificial Sequence
  Peptide Derived from Human Papillomavirus
STPIPGVR

SEQ ID NO: 42590 - protein, 9 aa, Artificial Sequence
  Peptide Derived from Human Papillomavirus
STPIPGVRR

SEQ ID NO: 42591 - protein, 8 aa, Artificial Sequence
  Peptide Derived from Human Papillomavirus
STSAVSAY

SEQ ID NO: 42592 - protein, 11 aa, Artificial Sequence
  Peptide Derived from Human Papillomavirus
STVSEASIPIR

SEQ ID NO: 42593 - protein, 9 aa, Artificial Sequence
  Peptide Derived from Human Papillomavirus
TCPSDVIPK

SEQ ID NO: 42594 - protein, 11 aa, Artificial Sequence
  Peptide Derived from Human Papillomavirus
TDFTVDTPATH

SEQ ID NO: 42595 - protein, 9 aa, Artificial Sequence
  Peptide Derived from Human Papillomavirus
TGYVPLSTR

SEQ ID NO: 42596 - protein, 8 aa, Artificial Sequence
  Peptide Derived from Human Papillomavirus
TIADQILR

SEQ ID NO: 42597 - protein, 9 aa, Artificial Sequence
  Peptide Derived from Human Papillomavirus
TIADQILRY

SEQ ID NO: 42598 - protein, 8 aa, Artificial Sequence
  Peptide Derived from Human Papillomavirus
TIGARVHY

SEQ ID NO: 42599 - protein, 9 aa, Artificial Sequence
  Peptide Derived from Human Papillomavirus
TIGARVHYY

SEQ ID NO: 42600 - protein, 10 aa, Artificial Sequence
  Peptide Derived from Human Papillomavirus
TIGARVHYYY

SEQ ID NO: 42601 - protein, 10 aa, Artificial Sequence
  Peptide Derived from Human Papillomavirus
TLNDGLYDIY

SEQ ID NO: 42602 - protein, 8 aa, Artificial Sequence
  Peptide Derived from Human Papillomavirus
TSRRNTVR

SEQ ID NO: 42603 - protein, 9 aa, Artificial Sequence
  Peptide Derived from Human Papillomavirus
TSRRNTVRY

SEQ ID NO: 42604 - protein, 11 aa, Artificial Sequence
  Peptide Derived from Human Papillomavirus
TSRRNTVRYSR

SEQ ID NO: 42605 - protein, 10 aa, Artificial Sequence
  Peptide Derived from Human Papillomavirus
TSSTPIPGVR

SEQ ID NO: 42606 - protein, 11 aa, Artificial Sequence
  Peptide Derived from Human Papillomavirus
TSSTPIPGVRR

SEQ ID NO: 42607 - protein, 9 aa, Artificial Sequence
  Peptide Derived from Human Papillomavirus
TSTLNDGLY

SEQ ID NO: 42608 - protein, 9 aa, Artificial Sequence
  Peptide Derived from Human Papillomavirus
TTIADQILR

SEQ ID NO: 42609 - protein, 10 aa, Artificial Sequence
  Peptide Derived from Human Papillomavirus
TTIADQILRY

SEQ ID NO: 42610 - protein, 10 aa, Artificial Sequence
  Peptide Derived from Human Papillomavirus
TTSTLNDGLY

SEQ ID NO: 42611 - protein, 11 aa, Artificial Sequence
  Peptide Derived from Human Papillomavirus
TTTSTLNDGLY

SEQ ID NO: 42612 - protein, 8 aa, Artificial Sequence
  Peptide Derived from Human Papillomavirus
TVDTPATH

SEQ ID NO: 42613 - protein, 9 aa, Artificial Sequence
  Peptide Derived from Human Papillomavirus
TVNAEESLY

SEQ ID NO: 42614 - protein, 10 aa, Artificial Sequence
  Peptide Derived from Human Papillomavirus
TVRYSRLGNK

SEQ ID NO: 42615 - protein, 10 aa, Artificial Sequence
  Peptide Derived from Human Papillomavirus
TVSEASIPIR

SEQ ID NO: 42616 - protein, 9 aa, Artificial Sequence
  Peptide Derived from Human Papillomavirus
VDGGDFYLH

SEQ ID NO: 42617 - protein, 11 aa, Artificial Sequence
  Peptide Derived from Human Papillomavirus
VDVGAPAPIPH

SEQ ID NO: 42618 - protein, 9 aa, Artificial Sequence
  Peptide Derived from Human Papillomavirus
VGAPAPIPH

SEQ ID NO: 42619 - protein, 11 aa, Artificial Sequence
  Peptide Derived from Human Papillomavirus
VIDPTFLSAPK

SEQ ID NO: 42620 - protein, 8 aa, Artificial Sequence
  Peptide Derived from Human Papillomavirus
VNAEESLY

SEQ ID NO: 42621 - protein, 9 aa, Artificial Sequence
  Peptide Derived from Human Papillomavirus
VSEASIPIR

SEQ ID NO: 42622 - protein, 11 aa, Artificial Sequence
  Peptide Derived from Human Papillomavirus
VSIFVDGGDFY

SEQ ID NO: 42623 - protein, 10 aa, Artificial Sequence
  Peptide Derived from Human Papillomavirus
YLHPSYYMLK

SEQ ID NO: 42624 - protein, 11 aa, Artificial Sequence
  Peptide Derived from Human Papillomavirus
YLHPSYYMLKR

SEQ ID NO: 42625 - protein, 8 aa, Artificial Sequence
  Peptide Derived from Human Papillomavirus
YMLKRRRK

SEQ ID NO: 42626 - protein, 9 aa, Artificial Sequence
  Peptide Derived from Human Papillomavirus
YMLKRRRKR

SEQ ID NO: 42627 - protein, 9 aa, Artificial Sequence
  Peptide Derived from Human Papillomavirus
YSKATQQVK

SEQ ID NO: 42628 - protein, 11 aa, Artificial Sequence
  Peptide Derived from Human Papillomavirus
YSRLGNKQTLR

SEQ ID NO: 42629 - protein, 8 aa, Artificial Sequence
  Peptide Derived from Human Papillomavirus
AAEDVVDR

SEQ ID NO: 42630 - protein, 11 aa, Artificial Sequence
  Peptide Derived from Human Papillomavirus
AAFLKSNSQAK

SEQ ID NO: 42631 - protein, 11 aa, Artificial Sequence
  Peptide Derived from Human Papillomavirus
AANPCRTSINK

SEQ ID NO: 42632 - protein, 11 aa, Artificial Sequence
  Peptide Derived from Human Papillomavirus
AFKKFLKGIPK

SEQ ID NO: 42633 - protein, 8 aa, Artificial Sequence
  Peptide Derived from Human Papillomavirus
AFLGAFKK

SEQ ID NO: 42634 - protein, 11 aa, Artificial Sequence
  Peptide Derived from Human Papillomavirus
AFLGAFKKFLK

SEQ ID NO: 42635 - protein, 10 aa, Artificial Sequence
  Peptide Derived from Human Papillomavirus
AFLKSNSQAK

SEQ ID NO: 42636 - protein, 9 aa, Artificial Sequence
  Peptide Derived from Human Papillomavirus
AGENTRSLR

SEQ ID NO: 42637 - protein, 9 aa, Artificial Sequence
  Peptide Derived from Human Papillomavirus
AGTDSRWPY

SEQ ID NO: 42638 - protein, 11 aa, Artificial Sequence
  Peptide Derived from Human Papillomavirus
AGTDSRWPYLH

SEQ ID NO: 42639 - protein, 8 aa, Artificial Sequence
  Peptide Derived from Human Papillomavirus
AINDENWK

SEQ ID NO: 42640 - protein, 8 aa, Artificial Sequence
  Peptide Derived from Human Papillomavirus
ANILYKFK

SEQ ID NO: 42641 - protein, 11 aa, Artificial Sequence
  Peptide Derived from Human Papillomavirus
ANILYKFKEAY

SEQ ID NO: 42642 - protein, 10 aa, Artificial Sequence
  Peptide Derived from Human Papillomavirus
ANPCRTSINK

SEQ ID NO: 42643 - protein, 8 aa, Artificial Sequence
  Peptide Derived from Human Papillomavirus
AVCALKRK

SEQ ID NO: 42644 - protein, 8 aa, Artificial Sequence
  Peptide Derived from Human Papillomavirus
CGIMCRHY

SEQ ID NO: 42645 - protein, 9 aa, Artificial Sequence
  Peptide Derived from Human Papillomavirus
CGIMCRHYK

SEQ ID NO: 42646 - protein, 10 aa, Artificial Sequence
  Peptide Derived from Human Papillomavirus
CGIMCRHYKK

SEQ ID NO: 42647 - protein, 8 aa, Artificial Sequence
  Peptide Derived from Human Papillomavirus
CGPANTGK

SEQ ID NO: 42648 - protein, 10 aa, Artificial Sequence
  Peptide Derived from Human Papillomavirus
CGPANTGKSY

SEQ ID NO: 42649 - protein, 8 aa, Artificial Sequence
  Peptide Derived from Human Papillomavirus
CMVIEPPK

SEQ ID NO: 42650 - protein, 10 aa, Artificial Sequence
  Peptide Derived from Human Papillomavirus
CMVIEPPKLR

SEQ ID NO: 42651 - protein, 8 aa, Artificial Sequence
  Peptide Derived from Human Papillomavirus
CSAGENTR

SEQ ID NO: 42652 - protein, 11 aa, Artificial Sequence
  Peptide Derived from Human Papillomavirus
CSAGENTRSLR

SEQ ID NO: 42653 - protein, 10 aa, Artificial Sequence
  Peptide Derived from Human Papillomavirus
CSKNRLTVAK

SEQ ID NO: 42654 - protein, 9 aa, Artificial Sequence
  Peptide Derived from Human Papillomavirus
CTDWCITGY

SEQ ID NO: 42655 - protein, 9 aa, Artificial Sequence
  Peptide Derived from Human Papillomavirus
CVISCVNSK

SEQ ID NO: 42656 - protein, 11 aa, Artificial Sequence
  Peptide Derived from Human Papillomavirus
CVISCVNSKSH

SEQ ID NO: 42657 - protein, 8 aa, Artificial Sequence
  Peptide Derived from Human Papillomavirus
DCGIMCRH

SEQ ID NO: 42658 - protein, 9 aa, Artificial Sequence
  Peptide Derived from Human Papillomavirus
DCGIMCRHY

SEQ ID NO: 42659 - protein, 10 aa, Artificial Sequence
  Peptide Derived from Human Papillomavirus
DCGIMCRHYK

SEQ ID NO: 42660 - protein, 11 aa, Artificial Sequence
  Peptide Derived from Human Papillomavirus
DCGIMCRHYKK

SEQ ID NO: 42661 - protein, 10 aa, Artificial Sequence
  Peptide Derived from Human Papillomavirus
DDLNAVCALK

SEQ ID NO: 42662 - protein, 11 aa, Artificial Sequence
  Peptide Derived from Human Papillomavirus
DDLNAVCALKR

SEQ ID NO: 42663 - protein, 8 aa, Artificial Sequence
  Peptide Derived from Human Papillomavirus
DDSDIAYY

SEQ ID NO: 42664 - protein, 9 aa, Artificial Sequence
  Peptide Derived from Human Papillomavirus
DDSDIAYYY

SEQ ID NO: 42665 - protein, 10 aa, Artificial Sequence
  Peptide Derived from Human Papillomavirus
DDVTPISWTY

SEQ ID NO: 42666 - protein, 10 aa, Artificial Sequence
  Peptide Derived from Human Papillomavirus
DGNEISIDVK

SEQ ID NO: 42667 - protein, 11 aa, Artificial Sequence
  Peptide Derived from Human Papillomavirus
DGNEISIDVKH

SEQ ID NO: 42668 - protein, 8 aa, Artificial Sequence
  Peptide Derived from Human Papillomavirus
DLIEEEDK

SEQ ID NO: 42669 - protein, 11 aa, Artificial Sequence
  Peptide Derived from Human Papillomavirus
DLIEEEDKENH

SEQ ID NO: 42670 - protein, 9 aa, Artificial Sequence
  Peptide Derived from Human Papillomavirus
DLNAVCALK

SEQ ID NO: 42671 - protein, 10 aa, Artificial Sequence
  Peptide Derived from Human Papillomavirus
DLNAVCALKR

SEQ ID NO: 42672 - protein, 11 aa, Artificial Sequence
  Peptide Derived from Human Papillomavirus
DLNAVCALKRK

SEQ ID NO: 42673 - protein, 10 aa, Artificial Sequence
  Peptide Derived from Human Papillomavirus
DLSEMVQWAY

SEQ ID NO: 42674 - protein, 8 aa, Artificial Sequence
  Peptide Derived from Human Papillomavirus
DSDIAYYY

SEQ ID NO: 42675 - protein, 11 aa, Artificial Sequence
  Peptide Derived from Human Papillomavirus
DSNSNAAAFLK

SEQ ID NO: 42676 - protein, 8 aa, Artificial Sequence
  Peptide Derived from Human Papillomavirus
DSRWPYLH

SEQ ID NO: 42677 - protein, 10 aa, Artificial Sequence
  Peptide Derived from Human Papillomavirus
DSRWPYLHSR

SEQ ID NO: 42678 - protein, 11 aa, Artificial Sequence
  Peptide Derived from Human Papillomavirus
DVKHRALVQLK

SEQ ID NO: 42679 - protein, 9 aa, Artificial Sequence
  Peptide Derived from Human Papillomavirus
DVTPISWTY

SEQ ID NO: 42680 - protein, 11 aa, Artificial Sequence
  Peptide Derived from Human Papillomavirus
DVVDRAANPCR

SEQ ID NO: 42681 - protein, 8 aa, Artificial Sequence
  Peptide Derived from Human Papillomavirus
ECTYRKRK

SEQ ID NO: 42682 - protein, 11 aa, Artificial Sequence
  Peptide Derived from Human Papillomavirus
EDDLNAVCALK

SEQ ID NO: 42683 - protein, 10 aa, Artificial Sequence
  Peptide Derived from Human Papillomavirus
EFTAFLGAFK

SEQ ID NO: 42684 - protein, 11 aa, Artificial Sequence
  Peptide Derived from Human Papillomavirus
EFTAFLGAFKK

SEQ ID NO: 42685 - protein, 8 aa, Artificial Sequence
  Peptide Derived from Human Papillomavirus
EISIDVKH

SEQ ID NO: 42686 - protein, 9 aa, Artificial Sequence
  Peptide Derived from Human Papillomavirus
EISIDVKHR

SEQ ID NO: 42687 - protein, 10 aa, Artificial Sequence
  Peptide Derived from Human Papillomavirus
ELTDDSDIAY

SEQ ID NO: 42688 - protein, 11 aa, Artificial Sequence
  Peptide Derived from Human Papillomavirus
ELTDDSDIAYY

SEQ ID NO: 42689 - protein, 10 aa, Artificial Sequence
  Peptide Derived from Human Papillomavirus
ELVRPFKSDK

SEQ ID NO: 42690 - protein, 11 aa, Artificial Sequence
  Peptide Derived from Human Papillomavirus
ENHGGNISTFK

SEQ ID NO: 42691 - protein, 9 aa, Artificial Sequence
  Peptide Derived from Human Papillomavirus
ENWKSFFSR

SEQ ID NO: 42692 - protein, 8 aa, Artificial Sequence
  Peptide Derived from Human Papillomavirus
ESLKVLIK

SEQ ID NO: 42693 - protein, 10 aa, Artificial Sequence
  Peptide Derived from Human Papillomavirus
ESLKVLIKQH

SEQ ID NO: 42694 - protein, 10 aa, Artificial Sequence
  Peptide Derived from Human Papillomavirus
ETCMVIEPPK

SEQ ID NO: 42695 - protein, 8 aa, Artificial Sequence
  Peptide Derived from Human Papillomavirus
EVEAVIER

SEQ ID NO: 42696 - protein, 9 aa, Artificial Sequence
  Peptide Derived from Human Papillomavirus
EVEAVIERR

SEQ ID NO: 42697 - protein, 9 aa, Artificial Sequence
  Peptide Derived from Human Papillomavirus
FDENGNPVY

SEQ ID NO: 42698 - protein, 11 aa, Artificial Sequence
  Peptide Derived from Human Papillomavirus
FDLSEMVQWAY

SEQ ID NO: 42699 - protein, 8 aa, Artificial Sequence
  Peptide Derived from Human Papillomavirus
FFSRTWCK

SEQ ID NO: 42700 - protein, 10 aa, Artificial Sequence
  Peptide Derived from Human Papillomavirus
FGMSLIQFLK

SEQ ID NO: 42701 - protein, 10 aa, Artificial Sequence
  Peptide Derived from Human Papillomavirus
FLGAFKKFLK

SEQ ID NO: 42702 - protein, 8 aa, Artificial Sequence
  Peptide Derived from Human Papillomavirus
FLKGIPKK

SEQ ID NO: 42703 - protein, 9 aa, Artificial Sequence
  Peptide Derived from Human Papillomavirus
FLKSNSQAK

SEQ ID NO: 42704 - protein, 9 aa, Artificial Sequence
  Peptide Derived from Human Papillomavirus
FMELVRPFK

SEQ ID NO: 42705 - protein, 9 aa, Artificial Sequence
  Peptide Derived from Human Papillomavirus
FTAFLGAFK

SEQ ID NO: 42706 - protein, 10 aa, Artificial Sequence
  Peptide Derived from Human Papillomavirus
FTAFLGAFKK

SEQ ID NO: 42707 - protein, 8 aa, Artificial Sequence
  Peptide Derived from Human Papillomavirus
GAFKKFLK

SEQ ID NO: 42708 - protein, 10 aa, Artificial Sequence
  Peptide Derived from Human Papillomavirus
GCVISCVNSK

SEQ ID NO: 42709 - protein, 8 aa, Artificial Sequence
  Peptide Derived from Human Papillomavirus
GGNISTFK

SEQ ID NO: 42710 - protein, 9 aa, Artificial Sequence
  Peptide Derived from Human Papillomavirus
GIIILLLIR

SEQ ID NO: 42711 - protein, 11 aa, Artificial Sequence
  Peptide Derived from Human Papillomavirus
GIIILLLIRFR

SEQ ID NO: 42712 - protein, 8 aa, Artificial Sequence
  Peptide Derived from Human Papillomavirus
GIMCRHYK

SEQ ID NO: 42713 - protein, 9 aa, Artificial Sequence
  Peptide Derived from Human Papillomavirus
GIMCRHYKK

SEQ ID NO: 42714 - protein, 9 aa, Artificial Sequence
  Peptide Derived from Human Papillomavirus
GISFMELVR

SEQ ID NO: 42715 - protein, 11 aa, Artificial Sequence
  Peptide Derived from Human Papillomavirus
GISPSVAESLK

SEQ ID NO: 42716 - protein, 9 aa, Artificial Sequence
  Peptide Derived from Human Papillomavirus
GMSLIQFLK

SEQ ID NO: 42717 - protein, 9 aa, Artificial Sequence
  Peptide Derived from Human Papillomavirus
GNEISIDVK

SEQ ID NO: 42718 - protein, 10 aa, Artificial Sequence
  Peptide Derived from Human Papillomavirus
GNEISIDVKH

SEQ ID NO: 42719 - protein, 11 aa, Artificial Sequence
  Peptide Derived from Human Papillomavirus
GNEISIDVKHR

SEQ ID NO: 42720 - protein, 11 aa, Artificial Sequence
  Peptide Derived from Human Papillomavirus
GNWRPIVQLLR

SEQ ID NO: 42721 - protein, 8 aa, Artificial Sequence
  Peptide Derived from Human Papillomavirus
GTDSRWPY

SEQ ID NO: 42722 - protein, 10 aa, Artificial Sequence
  Peptide Derived from Human Papillomavirus
GTDSRWPYLH

SEQ ID NO: 42723 - protein, 9 aa, Artificial Sequence
  Peptide Derived from Human Papillomavirus
GTTPEWIDR

SEQ ID NO: 42724 - protein, 11 aa, Artificial Sequence
  Peptide Derived from Human Papillomavirus
HFWLQPLSDAK

SEQ ID NO: 42725 - protein, 9 aa, Artificial Sequence
  Peptide Derived from Human Papillomavirus
HGGNISTFK

SEQ ID NO: 42726 - protein, 9 aa, Artificial Sequence
  Peptide Derived from Human Papillomavirus
HLQCLTCDR

SEQ ID NO: 42727 - protein, 10 aa, Artificial Sequence
  Peptide Derived from Human Papillomavirus
HSRLTVFEFK

SEQ ID NO: 42728 - protein, 11 aa, Artificial Sequence
  Peptide Derived from Human Papillomavirus
HSSNTKANILY

SEQ ID NO: 42729 - protein, 9 aa, Artificial Sequence
  Peptide Derived from Human Papillomavirus
ICGPANTGK

SEQ ID NO: 42730 - protein, 11 aa, Artificial Sequence
  Peptide Derived from Human Papillomavirus
ICGPANTGKSY

SEQ ID NO: 42731 - protein, 11 aa, Artificial Sequence
  Peptide Derived from Human Papillomavirus
IDDVTPISWTY

SEQ ID NO: 42732 - protein, 9 aa, Artificial Sequence
  Peptide Derived from Human Papillomavirus
IDELEDSGY

SEQ ID NO: 42733 - protein, 9 aa, Artificial Sequence
  Peptide Derived from Human Papillomavirus
IDRLTVLQH

SEQ ID NO: 42734 - protein, 8 aa, Artificial Sequence
  Peptide Derived from Human Papillomavirus
IGQWIQSR

SEQ ID NO: 42735 - protein, 11 aa, Artificial Sequence
  Peptide Derived from Human Papillomavirus
IGQWIQSRCEK

SEQ ID NO: 42736 - protein, 8 aa, Artificial Sequence
  Peptide Derived from Human Papillomavirus
IIILLLIR

SEQ ID NO: 42737 - protein, 10 aa, Artificial Sequence
  Peptide Derived from Human Papillomavirus
IIILLLIRFR

SEQ ID NO: 42738 - protein, 9 aa, Artificial Sequence
  Peptide Derived from Human Papillomavirus
IILLLIRFR

SEQ ID NO: 42739 - protein, 8 aa, Artificial Sequence
  Peptide Derived from Human Papillomavirus
ILLLIRFR

SEQ ID NO: 42740 - protein, 11 aa, Artificial Sequence
  Peptide Derived from Human Papillomavirus
ILLLIRFRCSK

SEQ ID NO: 42741 - protein, 9 aa, Artificial Sequence
  Peptide Derived from Human Papillomavirus
ILYKFKEAY

SEQ ID NO: 42742 - protein, 8 aa, Artificial Sequence
  Peptide Derived from Human Papillomavirus
IMCRHYKK

SEQ ID NO: 42743 - protein, 11 aa, Artificial Sequence
  Peptide Derived from Human Papillomavirus
IMCRHYKKAEK

SEQ ID NO: 42744 - protein, 9 aa, Artificial Sequence
  Peptide Derived from Human Papillomavirus
INKNKECTY

SEQ ID NO: 42745 - protein, 10 aa, Artificial Sequence
  Peptide Derived from Human Papillomavirus
INKNKECTYR

SEQ ID NO: 42746 - protein, 11 aa, Artificial Sequence
  Peptide Derived from Human Papillomavirus
INKNKECTYRK

SEQ ID NO: 42747 - protein, 9 aa, Artificial Sequence
  Peptide Derived from Human Papillomavirus
ISCVNSKSH

SEQ ID NO: 42748 - protein, 8 aa, Artificial Sequence
  Peptide Derived from Human Papillomavirus
ISFMELVR

SEQ ID NO: 42749 - protein, 11 aa, Artificial Sequence
  Peptide Derived from Human Papillomavirus
ISFMELVRPFK

SEQ ID NO: 42750 - protein, 8 aa, Artificial Sequence
  Peptide Derived from Human Papillomavirus
ISIDVKHR

SEQ ID NO: 42751 - protein, 11 aa, Artificial Sequence
  Peptide Derived from Human Papillomavirus
ISNVLHSSNTK

SEQ ID NO: 42752 - protein, 10 aa, Artificial Sequence
  Peptide Derived from Human Papillomavirus
ISPSVAESLK

SEQ ID NO: 42753 - protein, 9 aa, Artificial Sequence
  Peptide Derived from Human Papillomavirus
ISWTYIDDY

SEQ ID NO: 42754 - protein, 11 aa, Artificial Sequence
  Peptide Derived from Human Papillomavirus
ISWTYIDDYMR

SEQ ID NO: 42755 - protein, 10 aa, Artificial Sequence
  Peptide Derived from Human Papillomavirus
IVKDCGIMCR

SEQ ID NO: 42756 - protein, 11 aa, Artificial Sequence
  Peptide Derived from Human Papillomavirus
IVKDCGIMCRH

SEQ ID NO: 42757 - protein, 9 aa, Artificial Sequence
  Peptide Derived from Human Papillomavirus
KANILYKFK

SEQ ID NO: 42758 - protein, 9 aa, Artificial Sequence
  Peptide Derived from Human Papillomavirus
KCSAGENTR

SEQ ID NO: 42759 - protein, 8 aa, Artificial Sequence
  Peptide Derived from Human Papillomavirus
KDCGIMCR

SEQ ID NO: 42760 - protein, 9 aa, Artificial Sequence
  Peptide Derived from Human Papillomavirus
KDCGIMCRH

SEQ ID NO: 42761 - protein, 10 aa, Artificial Sequence
  Peptide Derived from Human Papillomavirus
KDCGIMCRHY

SEQ ID NO: 42762 - protein, 11 aa, Artificial Sequence
  Peptide Derived from Human Papillomavirus
KDCGIMCRHYK

SEQ ID NO: 42763 - protein, 8 aa, Artificial Sequence
  Peptide Derived from Human Papillomavirus
KFLKGIPK

SEQ ID NO: 42764 - protein, 9 aa, Artificial Sequence
  Peptide Derived from Human Papillomavirus
KFLKGIPKK

SEQ ID NO: 42765 - protein, 11 aa, Artificial Sequence
  Peptide Derived from Human Papillomavirus
KGCVISCVNSK

SEQ ID NO: 42766 - protein, 10 aa, Artificial Sequence
  Peptide Derived from Human Papillomavirus
KIDELEDSGY

SEQ ID NO: 42767 - protein, 11 aa, Artificial Sequence
  Peptide Derived from Human Papillomavirus
KIVKDCGIMCR

SEQ ID NO: 42768 - protein, 10 aa, Artificial Sequence
  Peptide Derived from Human Papillomavirus
KLDLIEEEDK

SEQ ID NO: 42769 - protein, 10 aa, Artificial Sequence
  Peptide Derived from Human Papillomavirus
KLRSQTCALY

SEQ ID NO: 42770 - protein, 11 aa, Artificial Sequence
  Peptide Derived from Human Papillomavirus
KMSIGQWIQSR

SEQ ID NO: 42771 - protein, 8 aa, Artificial Sequence
  Peptide Derived from Human Papillomavirus
KNKECTYR

SEQ ID NO: 42772 - protein, 9 aa, Artificial Sequence
  Peptide Derived from Human Papillomavirus
KNKECTYRK

SEQ ID NO: 42773 - protein, 10 aa, Artificial Sequence
  Peptide Derived from Human Papillomavirus
KNKECTYRKR

SEQ ID NO: 42774 - protein, 11 aa, Artificial Sequence
  Peptide Derived from Human Papillomavirus
KNKECTYRKRK

SEQ ID NO: 42775 - protein, 8 aa, Artificial Sequence
  Peptide Derived from Human Papillomavirus
KNRLTVAK

SEQ ID NO: 42776 - protein, 10 aa, Artificial Sequence
  Peptide Derived from Human Papillomavirus
KSFFSRTWCK

SEQ ID NO: 42777 - protein, 10 aa, Artificial Sequence
  Peptide Derived from Human Papillomavirus
KSNSQAKIVK

SEQ ID NO: 42778 - protein, 9 aa, Artificial Sequence
  Peptide Derived from Human Papillomavirus
KTNDGGNWR

SEQ ID NO: 42779 - protein, 10 aa, Artificial Sequence
  Peptide Derived from Human Papillomavirus
KVLIKQHSLY

SEQ ID NO: 42780 - protein, 11 aa, Artificial Sequence
  Peptide Derived from Human Papillomavirus
LDGNEISIDVK

SEQ ID NO: 42781 - protein, 9 aa, Artificial Sequence
  Peptide Derived from Human Papillomavirus
LDLIEEEDK

SEQ ID NO: 42782 - protein, 9 aa, Artificial Sequence
  Peptide Derived from Human Papillomavirus
LGAFKKFLK

SEQ ID NO: 42783 - protein, 10 aa, Artificial Sequence
  Peptide Derived from Human Papillomavirus
LICGPANTGK

SEQ ID NO: 42784 - protein, 10 aa, Artificial Sequence
  Peptide Derived from Human Papillomavirus
LIEEEDKENH

SEQ ID NO: 42785 - protein, 8 aa, Artificial Sequence
  Peptide Derived from Human Papillomavirus
LIKQHSLY

SEQ ID NO: 42786 - protein, 10 aa, Artificial Sequence
  Peptide Derived from Human Papillomavirus
LIKQHSLYTH

SEQ ID NO: 42787 - protein, 8 aa, Artificial Sequence
  Peptide Derived from Human Papillomavirus
LIRFRCSK

SEQ ID NO: 42788 - protein, 10 aa, Artificial Sequence
  Peptide Derived from Human Papillomavirus
LIRFRCSKNR

SEQ ID NO: 42789 - protein, 9 aa, Artificial Sequence
  Peptide Derived from Human Papillomavirus
LLIRFRCSK

SEQ ID NO: 42790 - protein, 11 aa, Artificial Sequence
  Peptide Derived from Human Papillomavirus
LLIRFRCSKNR

SEQ ID NO: 42791 - protein, 10 aa, Artificial Sequence
  Peptide Derived from Human Papillomavirus
LLLIRFRCSK

SEQ ID NO: 42792 - protein, 8 aa, Artificial Sequence
  Peptide Derived from Human Papillomavirus
LNAVCALK

SEQ ID NO: 42793 - protein, 9 aa, Artificial Sequence
  Peptide Derived from Human Papillomavirus
LNAVCALKR

SEQ ID NO: 42794 - protein, 10 aa, Artificial Sequence
  Peptide Derived from Human Papillomavirus
LNAVCALKRK

SEQ ID NO: 42795 - protein, 9 aa, Artificial Sequence
  Peptide Derived from Human Papillomavirus
LSEMVQWAY

SEQ ID NO: 42796 - protein, 9 aa, Artificial Sequence
  Peptide Derived from Human Papillomavirus
LTDDSDIAY

SEQ ID NO: 42797 - protein, 10 aa, Artificial Sequence
  Peptide Derived from Human Papillomavirus
LTDDSDIAYY

SEQ ID NO: 42798 - protein, 11 aa, Artificial Sequence
  Peptide Derived from Human Papillomavirus
LTDDSDIAYYY

SEQ ID NO: 42799 - protein, 9 aa, Artificial Sequence
  Peptide Derived from Human Papillomavirus
LVRPFKSDK

SEQ ID NO: 42800 - protein, 10 aa, Artificial Sequence
  Peptide Derived from Human Papillomavirus
MCRHYKKAEK

SEQ ID NO: 42801 - protein, 11 aa, Artificial Sequence
  Peptide Derived from Human Papillomavirus
MCRHYKKAEKR

SEQ ID NO: 42802 - protein, 11 aa, Artificial Sequence
  Peptide Derived from Human Papillomavirus
MLICGPANTGK

SEQ ID NO: 42803 - protein, 10 aa, Artificial Sequence
  Peptide Derived from Human Papillomavirus
MSIGQWIQSR

SEQ ID NO: 42804 - protein, 8 aa, Artificial Sequence
  Peptide Derived from Human Papillomavirus
MSLIQFLK

SEQ ID NO: 42805 - protein, 9 aa, Artificial Sequence
  Peptide Derived from Human Papillomavirus
MVIEPPKLR

SEQ ID NO: 42806 - protein, 10 aa, Artificial Sequence
  Peptide Derived from Human Papillomavirus
NAGTDSRWPY

SEQ ID NO: 42807 - protein, 8 aa, Artificial Sequence
  Peptide Derived from Human Papillomavirus
NAVCALKR

SEQ ID NO: 42808 - protein, 9 aa, Artificial Sequence
  Peptide Derived from Human Papillomavirus
NAVCALKRK

SEQ ID NO: 42809 - protein, 11 aa, Artificial Sequence
  Peptide Derived from Human Papillomavirus
NDENWKSFFSR

SEQ ID NO: 42810 - protein, 10 aa, Artificial Sequence
  Peptide Derived from Human Papillomavirus
NILYKFKEAY

SEQ ID NO: 42811 - protein, 11 aa, Artificial Sequence
  Peptide Derived from Human Papillomavirus
NSIQADTEAAR

SEQ ID NO: 42812 - protein, 9 aa, Artificial Sequence
  Peptide Derived from Human Papillomavirus
NSNAAAFLK

SEQ ID NO: 42813 - protein, 8 aa, Artificial Sequence
  Peptide Derived from Human Papillomavirus
NSQAKIVK

SEQ ID NO: 42814 - protein, 8 aa, Artificial Sequence
  Peptide Derived from Human Papillomavirus
NTKANILY

SEQ ID NO: 42815 - protein, 9 aa, Artificial Sequence
  Peptide Derived from Human Papillomavirus
NTKANILYK

SEQ ID NO: 42816 - protein, 11 aa, Artificial Sequence
  Peptide Derived from Human Papillomavirus
NTKANILYKFK

SEQ ID NO: 42817 - protein, 9 aa, Artificial Sequence
  Peptide Derived from Human Papillomavirus
NTNAGTDSR

SEQ ID NO: 42818 - protein, 9 aa, Artificial Sequence
  Peptide Derived from Human Papillomavirus
NVLHSSNTK

SEQ ID NO: 42819 - protein, 8 aa, Artificial Sequence
  Peptide Derived from Human Papillomavirus
PANTGKSY

SEQ ID NO: 42820 - protein, 8 aa, Artificial Sequence
  Peptide Derived from Human Papillomavirus
PCRTSINK

SEQ ID NO: 42821 - protein, 10 aa, Artificial Sequence
  Peptide Derived from Human Papillomavirus
PCRTSINKNK

SEQ ID NO: 42822 - protein, 10 aa, Artificial Sequence
  Peptide Derived from Human Papillomavirus
PFDENGNPVY

SEQ ID NO: 42823 - protein, 10 aa, Artificial Sequence
  Peptide Derived from Human Papillomavirus
PISWTYIDDY

SEQ ID NO: 42824 - protein, 8 aa, Artificial Sequence
  Peptide Derived from Human Papillomavirus
PIVQLLRY

SEQ ID NO: 42825 - protein, 8 aa, Artificial Sequence
  Peptide Derived from Human Papillomavirus
PSVAESLK

SEQ ID NO: 42826 - protein, 11 aa, Artificial Sequence
  Peptide Derived from Human Papillomavirus
PVYAINDENWK

SEQ ID NO: 42827 - protein, 8 aa, Artificial Sequence
  Peptide Derived from Human Papillomavirus
QADTEAAR

SEQ ID NO: 42828 - protein, 10 aa, Artificial Sequence
  Peptide Derived from Human Papillomavirus
QGTTPEWIDR

SEQ ID NO: 42829 - protein, 10 aa, Artificial Sequence
  Peptide Derived from Human Papillomavirus
QSAAEDVVDR

SEQ ID NO: 42830 - protein, 9 aa, Artificial Sequence
  Peptide Derived from Human Papillomavirus
QTCALYWFR

SEQ ID NO: 42831 - protein, 11 aa, Artificial Sequence
  Peptide Derived from Human Papillomavirus
RCSKNRLTVAK

SEQ ID NO: 42832 - protein, 8 aa, Artificial Sequence
  Peptide Derived from Human Papillomavirus
RFRCSKNR

SEQ ID NO: 42833 - protein, 10 aa, Artificial Sequence
  Peptide Derived from Human Papillomavirus
RGIIILLLIR

SEQ ID NO: 42834 - protein, 8 aa, Artificial Sequence
  Peptide Derived from Human Papillomavirus
RLTVFEFK

SEQ ID NO: 42835 - protein, 8 aa, Artificial Sequence
  Peptide Derived from Human Papillomavirus
RSQTCALY

SEQ ID NO: 42836 - protein, 11 aa, Artificial Sequence
  Peptide Derived from Human Papillomavirus
RSQTCALYWFR

SEQ ID NO: 42837 - protein, 8 aa, Artificial Sequence
  Peptide Derived from Human Papillomavirus
RTSINKNK

SEQ ID NO: 42838 - protein, 9 aa, Artificial Sequence
  Peptide Derived from Human Papillomavirus
SAAEDVVDR

SEQ ID NO: 42839 - protein, 10 aa, Artificial Sequence
  Peptide Derived from Human Papillomavirus
SAGENTRSLR

SEQ ID NO: 42840 - protein, 10 aa, Artificial Sequence
  Peptide Derived from Human Papillomavirus
SCTDWCITGY

SEQ ID NO: 42841 - protein, 8 aa, Artificial Sequence
  Peptide Derived from Human Papillomavirus
SCVNSKSH

SEQ ID NO: 42842 - protein, 9 aa, Artificial Sequence
  Peptide Derived from Human Papillomavirus
SFFSRTWCK

SEQ ID NO: 42843 - protein, 10 aa, Artificial Sequence
  Peptide Derived from Human Papillomavirus
SFMELVRPFK

SEQ ID NO: 42844 - protein, 9 aa, Artificial Sequence
  Peptide Derived from Human Papillomavirus
SIGQWIQSR

SEQ ID NO: 42845 - protein, 10 aa, Artificial Sequence
  Peptide Derived from Human Papillomavirus
SINKNKECTY

SEQ ID NO: 42846 - protein, 11 aa, Artificial Sequence
  Peptide Derived from Human Papillomavirus
SINKNKECTYR

SEQ ID NO: 42847 - protein, 10 aa, Artificial Sequence
  Peptide Derived from Human Papillomavirus
SIQADTEAAR

SEQ ID NO: 42848 - protein, 9 aa, Artificial Sequence
  Peptide Derived from Human Papillomavirus
SLKVLIKQH

SEQ ID NO: 42849 - protein, 8 aa, Artificial Sequence
  Peptide Derived from Human Papillomavirus
SNAAAFLK

SEQ ID NO: 42850 - protein, 10 aa, Artificial Sequence
  Peptide Derived from Human Papillomavirus
SNSNAAAFLK

SEQ ID NO: 42851 - protein, 9 aa, Artificial Sequence
  Peptide Derived from Human Papillomavirus
SNSQAKIVK

SEQ ID NO: 42852 - protein, 9 aa, Artificial Sequence
  Peptide Derived from Human Papillomavirus
SNTKANILY

SEQ ID NO: 42853 - protein, 10 aa, Artificial Sequence
  Peptide Derived from Human Papillomavirus
SNTKANILYK

SEQ ID NO: 42854 - protein, 10 aa, Artificial Sequence
  Peptide Derived from Human Papillomavirus
SNTNAGTDSR

SEQ ID NO: 42855 - protein, 10 aa, Artificial Sequence
  Peptide Derived from Human Papillomavirus
SNVLHSSNTK

SEQ ID NO: 42856 - protein, 10 aa, Artificial Sequence
  Peptide Derived from Human Papillomavirus
SSNTKANILY

SEQ ID NO: 42857 - protein, 11 aa, Artificial Sequence
  Peptide Derived from Human Papillomavirus
SSNTKANILYK

SEQ ID NO: 42858 - protein, 11 aa, Artificial Sequence
  Peptide Derived from Human Papillomavirus
SVAESLKVLIK

SEQ ID NO: 42859 - protein, 8 aa, Artificial Sequence
  Peptide Derived from Human Papillomavirus
TAFLGAFK

SEQ ID NO: 42860 - protein, 9 aa, Artificial Sequence
  Peptide Derived from Human Papillomavirus
TAFLGAFKK

SEQ ID NO: 42861 - protein, 8 aa, Artificial Sequence
  Peptide Derived from Human Papillomavirus
TCALYWFR

SEQ ID NO: 42862 - protein, 9 aa, Artificial Sequence
  Peptide Derived from Human Papillomavirus
TCMVIEPPK

SEQ ID NO: 42863 - protein, 11 aa, Artificial Sequence
  Peptide Derived from Human Papillomavirus
TCMVIEPPKLR

SEQ ID NO: 42864 - protein, 8 aa, Artificial Sequence
  Peptide Derived from Human Papillomavirus
TDDSDIAY

SEQ ID NO: 42865 - protein, 9 aa, Artificial Sequence
  Peptide Derived from Human Papillomavirus
TDDSDIAYY

SEQ ID NO: 42866 - protein, 10 aa, Artificial Sequence
  Peptide Derived from Human Papillomavirus
TDDSDIAYYY

SEQ ID NO: 42867 - protein, 9 aa, Artificial Sequence
  Peptide Derived from Human Papillomavirus
TDSRWPYLH

SEQ ID NO: 42868 - protein, 11 aa, Artificial Sequence
  Peptide Derived from Human Papillomavirus
TDSRWPYLHSR

SEQ ID NO: 42869 - protein, 8 aa, Artificial Sequence
  Peptide Derived from Human Papillomavirus
TDWCITGY

SEQ ID NO: 42870 - protein, 11 aa, Artificial Sequence
  Peptide Derived from Human Papillomavirus
TFKCSAGENTR

SEQ ID NO: 42871 - protein, 10 aa, Artificial Sequence
  Peptide Derived from Human Papillomavirus
TLQEISNVLH

SEQ ID NO: 42872 - protein, 8 aa, Artificial Sequence
  Peptide Derived from Human Papillomavirus
TNAGTDSR

SEQ ID NO: 42873 - protein, 11 aa, Artificial Sequence
  Peptide Derived from Human Papillomavirus
TNAGTDSRWPY

SEQ ID NO: 42874 - protein, 8 aa, Artificial Sequence
  Peptide Derived from Human Papillomavirus
TNDGGNWR

SEQ ID NO: 42875 - protein, 11 aa, Artificial Sequence
  Peptide Derived from Human Papillomavirus
TSCTDWCITGY

SEQ ID NO: 42876 - protein, 11 aa, Artificial Sequence
  Peptide Derived from Human Papillomavirus
TSINKNKECTY

SEQ ID NO: 42877 - protein, 11 aa, Artificial Sequence
  Peptide Derived from Human Papillomavirus
TSNTNAGTDSR

SEQ ID NO: 42878 - protein, 8 aa, Artificial Sequence
  Peptide Derived from Human Papillomavirus
TTPEWIDR

SEQ ID NO: 42879 - protein, 10 aa, Artificial Sequence
  Peptide Derived from Human Papillomavirus
VAESLKVLIK

SEQ ID NO: 42880 - protein, 9 aa, Artificial Sequence
  Peptide Derived from Human Papillomavirus
VDRAANPCR

SEQ ID NO: 42881 - protein, 8 aa, Artificial Sequence
  Peptide Derived from Human Papillomavirus
VIEPPKLR

SEQ ID NO: 42882 - protein, 8 aa, Artificial Sequence
  Peptide Derived from Human Papillomavirus
VISCVNSK

SEQ ID NO: 42883 - protein, 10 aa, Artificial Sequence
  Peptide Derived from Human Papillomavirus
VISCVNSKSH

SEQ ID NO: 42884 - protein, 8 aa, Artificial Sequence
  Peptide Derived from Human Papillomavirus
VLHSSNTK

SEQ ID NO: 42885 - protein, 9 aa, Artificial Sequence
  Peptide Derived from Human Papillomavirus
VLIKQHSLY

SEQ ID NO: 42886 - protein, 11 aa, Artificial Sequence
  Peptide Derived from Human Papillomavirus
VLIKQHSLYTH

SEQ ID NO: 42887 - protein, 11 aa, Artificial Sequence
  Peptide Derived from Human Papillomavirus
VTLQEISNVLH

SEQ ID NO: 42888 - protein, 8 aa, Artificial Sequence
  Peptide Derived from Human Papillomavirus
VTPISWTY

SEQ ID NO: 42889 - protein, 10 aa, Artificial Sequence
  Peptide Derived from Human Papillomavirus
VVDRAANPCR

SEQ ID NO: 42890 - protein, 10 aa, Artificial Sequence
  Peptide Derived from Human Papillomavirus
WFEVEAVIER

SEQ ID NO: 42891 - protein, 11 aa, Artificial Sequence
  Peptide Derived from Human Papillomavirus
WFEVEAVIERR

SEQ ID NO: 42892 - protein, 10 aa, Artificial Sequence
  Peptide Derived from Human Papillomavirus
WIDRLTVLQH

SEQ ID NO: 42893 - protein, 8 aa, Artificial Sequence
  Peptide Derived from Human Papillomavirus
WIQSRCEK

SEQ ID NO: 42894 - protein, 9 aa, Artificial Sequence
  Peptide Derived from Human Papillomavirus
WLQPLSDAK

SEQ ID NO: 42895 - protein, 9 aa, Artificial Sequence
  Peptide Derived from Human Papillomavirus
WTYIDDYMR

SEQ ID NO: 42896 - protein, 9 aa, Artificial Sequence
  Peptide Derived from Human Papillomavirus
YAINDENWK

SEQ ID NO: 42897 - protein, 11 aa, Artificial Sequence
  Peptide Derived from Human Papillomavirus
YFGMSLIQFLK

SEQ ID NO: 42898 - protein, 10 aa, Artificial Sequence
  Peptide Derived from Human Papillomavirus
YGISFMELVR

SEQ ID NO: 42899 - protein, 11 aa, Artificial Sequence
  Peptide Derived from Human Papillomavirus
YTHLQCLTCDR

SEQ ID NO: 42900 - protein, 10 aa, Artificial Sequence
  Peptide Derived from Human Papillomavirus
ADIQTDNDNR

SEQ ID NO: 42901 - protein, 8 aa, Artificial Sequence
  Peptide Derived from Human Papillomavirus
ADPALDNR

SEQ ID NO: 42902 - protein, 11 aa, Artificial Sequence
  Peptide Derived from Human Papillomavirus
ADPALDNRTAR

SEQ ID NO: 42903 - protein, 8 aa, Artificial Sequence
  Peptide Derived from Human Papillomavirus
ALDNRTAR

SEQ ID NO: 42904 - protein, 10 aa, Artificial Sequence
  Peptide Derived from Human Papillomavirus
ALETLSKSQY

SEQ ID NO: 42905 - protein, 9 aa, Artificial Sequence
  Peptide Derived from Human Papillomavirus
ATNCTNKQR

SEQ ID NO: 42906 - protein, 10 aa, Artificial Sequence
  Peptide Derived from Human Papillomavirus
AVQEKILDLY

SEQ ID NO: 42907 - protein, 9 aa, Artificial Sequence
  Peptide Derived from Human Papillomavirus
CADPALDNR

SEQ ID NO: 42908 - protein, 8 aa, Artificial Sequence
  Peptide Derived from Human Papillomavirus
CALLYTAK

SEQ ID NO: 42909 - protein, 9 aa, Artificial Sequence
  Peptide Derived from Human Papillomavirus
CLRYRLKPY

SEQ ID NO: 42910 - protein, 10 aa, Artificial Sequence
  Peptide Derived from Human Papillomavirus
CLRYRLKPYK

SEQ ID NO: 42911 - protein, 10 aa, Artificial Sequence
  Peptide Derived from Human Papillomavirus
CSSNVAPIVH

SEQ ID NO: 42912 - protein, 10 aa, Artificial Sequence
  Peptide Derived from Human Papillomavirus
CTMVTGKVDY

SEQ ID NO: 42913 - protein, 9 aa, Artificial Sequence
  Peptide Derived from Human Papillomavirus
DIQTDNDNR

SEQ ID NO: 42914 - protein, 8 aa, Artificial Sequence
  Peptide Derived from Human Papillomavirus
DLPSQIEH

SEQ ID NO: 42915 - protein, 10 aa, Artificial Sequence
  Peptide Derived from Human Papillomavirus
DLPSQIEHWK

SEQ ID NO: 42916 - protein, 10 aa, Artificial Sequence
  Peptide Derived from Human Papillomavirus
DNDKKNTMDY

SEQ ID NO: 42917 - protein, 10 aa, Artificial Sequence
  Peptide Derived from Human Papillomavirus
DNRPPQAAAK

SEQ ID NO: 42918 - protein, 11 aa, Artificial Sequence
  Peptide Derived from Human Papillomavirus
DNRPPQAAAKR

SEQ ID NO: 42919 - protein, 8 aa, Artificial Sequence
  Peptide Derived from Human Papillomavirus
DTAQPLTK

SEQ ID NO: 42920 - protein, 9 aa, Artificial Sequence
  Peptide Derived from Human Papillomavirus
DTCTMVTGK

SEQ ID NO: 42921 - protein, 11 aa, Artificial Sequence
  Peptide Derived from Human Papillomavirus
DTTDTAQPLTK

SEQ ID NO: 42922 - protein, 9 aa, Artificial Sequence
  Peptide Derived from Human Papillomavirus
ECALLYTAK

SEQ ID NO: 42923 - protein, 8 aa, Artificial Sequence
  Peptide Derived from Human Papillomavirus
EDAAKYSK

SEQ ID NO: 42924 - protein, 10 aa, Artificial Sequence
  Peptide Derived from Human Papillomavirus
EDTCTMVTGK

SEQ ID NO: 42925 - protein, 11 aa, Artificial Sequence
  Peptide Derived from Human Papillomavirus
ELQMALETLSK

SEQ ID NO: 42926 - protein, 11 aa, Artificial Sequence
  Peptide Derived from Human Papillomavirus
ELYSSMSSTWH

SEQ ID NO: 42927 - protein, 9 aa, Artificial Sequence
  Peptide Derived from Human Papillomavirus
ESNSLKCLR

SEQ ID NO: 42928 - protein, 10 aa, Artificial Sequence
  Peptide Derived from Human Papillomavirus
ESNSLKCLRY

SEQ ID NO: 42929 - protein, 11 aa, Artificial Sequence
  Peptide Derived from Human Papillomavirus
ESNSLKCLRYR

SEQ ID NO: 42930 - protein, 8 aa, Artificial Sequence
  Peptide Derived from Human Papillomavirus
ETLSKSQY

SEQ ID NO: 42931 - protein, 11 aa, Artificial Sequence
  Peptide Derived from Human Papillomavirus
ETVTVQYDNDK

SEQ ID NO: 42932 - protein, 9 aa, Artificial Sequence
  Peptide Derived from Human Papillomavirus
EVWLCEPPK

SEQ ID NO: 42933 - protein, 10 aa, Artificial Sequence
  Peptide Derived from Human Papillomavirus
FCADPALDNR

SEQ ID NO: 42934 - protein, 10 aa, Artificial Sequence
  Peptide Derived from Human Papillomavirus
GMYYIHNCEK

SEQ ID NO: 42935 - protein, 10 aa, Artificial Sequence
  Peptide Derived from Human Papillomavirus
HLKGESNSLK

SEQ ID NO: 42936 - protein, 9 aa, Artificial Sequence
  Peptide Derived from Human Papillomavirus
HNCEKVYFK

SEQ ID NO: 42937 - protein, 10 aa, Artificial Sequence
  Peptide Derived from Human Papillomavirus
HNCEKVYFKY

SEQ ID NO: 42938 - protein, 11 aa, Artificial Sequence
  Peptide Derived from Human Papillomavirus
IGMYYIHNCEK

SEQ ID NO: 42939 - protein, 9 aa, Artificial Sequence
  Peptide Derived from Human Papillomavirus
ILDLYEADK

SEQ ID NO: 42940 - protein, 11 aa, Artificial Sequence
  Peptide Derived from Human Papillomavirus
ISARLNAVQEK

SEQ ID NO: 42941 - protein, 8 aa, Artificial Sequence
  Peptide Derived from Human Papillomavirus
KCLRYRLK

SEQ ID NO: 42942 - protein, 10 aa, Artificial Sequence
  Peptide Derived from Human Papillomavirus
KCLRYRLKPY

SEQ ID NO: 42943 - protein, 11 aa, Artificial Sequence
  Peptide Derived from Human Papillomavirus
KCLRYRLKPYK

SEQ ID NO: 42944 - protein, 8 aa, Artificial Sequence
  Peptide Derived from Human Papillomavirus
KGESNSLK

SEQ ID NO: 42945 - protein, 11 aa, Artificial Sequence
  Peptide Derived from Human Papillomavirus
KGESNSLKCLR

SEQ ID NO: 42946 - protein, 10 aa, Artificial Sequence
  Peptide Derived from Human Papillomavirus
KILDLYEADK

SEQ ID NO: 42947 - protein, 11 aa, Artificial Sequence
  Peptide Derived from Human Papillomavirus
KLIRMECALLY

SEQ ID NO: 42948 - protein, 10 aa, Artificial Sequence
  Peptide Derived from Human Papillomavirus
KTDLPSQIEH

SEQ ID NO: 42949 - protein, 8 aa, Artificial Sequence
  Peptide Derived from Human Papillomavirus
KTQMWEVH

SEQ ID NO: 42950 - protein, 8 aa, Artificial Sequence
  Peptide Derived from Human Papillomavirus
KVDYIGMY

SEQ ID NO: 42951 - protein, 9 aa, Artificial Sequence
  Peptide Derived from Human Papillomavirus
KVDYIGMYY

SEQ ID NO: 42952 - protein, 11 aa, Artificial Sequence
  Peptide Derived from Human Papillomavirus
KVDYIGMYYIH

SEQ ID NO: 42953 - protein, 8 aa, Artificial Sequence
  Peptide Derived from Human Papillomavirus
KVYFKYFK

SEQ ID NO: 42954 - protein, 9 aa, Artificial Sequence
  Peptide Derived from Human Papillomavirus
LCEPPKCFK

SEQ ID NO: 42955 - protein, 10 aa, Artificial Sequence
  Peptide Derived from Human Papillomavirus
LCEPPKCFKK

SEQ ID NO: 42956 - protein, 8 aa, Artificial Sequence
  Peptide Derived from Human Papillomavirus
LDLYEADK

SEQ ID NO: 42957 - protein, 11 aa, Artificial Sequence
  Peptide Derived from Human Papillomavirus
LFCADPALDNR

SEQ ID NO: 42958 - protein, 10 aa, Artificial Sequence
  Peptide Derived from Human Papillomavirus
LIRMECALLY

SEQ ID NO: 42959 - protein, 8 aa, Artificial Sequence
  Peptide Derived from Human Papillomavirus
MALETLSK

SEQ ID NO: 42960 - protein, 11 aa, Artificial Sequence
  Peptide Derived from Human Papillomavirus
MALETLSKSQY

SEQ ID NO: 42961 - protein, 10 aa, Artificial Sequence
  Peptide Derived from Human Papillomavirus
MDYTNWGEIY

SEQ ID NO: 42962 - protein, 8 aa, Artificial Sequence
  Peptide Derived from Human Papillomavirus
MGFSHLCH

SEQ ID NO: 42963 - protein, 8 aa, Artificial Sequence
  Peptide Derived from Human Papillomavirus
MVTGKVDY

SEQ ID NO: 42964 - protein, 11 aa, Artificial Sequence
  Peptide Derived from Human Papillomavirus
NAVQEKILDLY

SEQ ID NO: 42965 - protein, 8 aa, Artificial Sequence
  Peptide Derived from Human Papillomavirus
NCEKVYFK

SEQ ID NO: 42966 - protein, 9 aa, Artificial Sequence
  Peptide Derived from Human Papillomavirus
NCEKVYFKY

SEQ ID NO: 42967 - protein, 11 aa, Artificial Sequence
  Peptide Derived from Human Papillomavirus
NCEKVYFKYFK

SEQ ID NO: 42968 - protein, 9 aa, Artificial Sequence
  Peptide Derived from Human Papillomavirus
NDKKNTMDY

SEQ ID NO: 42969 - protein, 11 aa, Artificial Sequence
  Peptide Derived from Human Papillomavirus
NDNRPPQAAAK

SEQ ID NO: 42970 - protein, 8 aa, Artificial Sequence
  Peptide Derived from Human Papillomavirus
NSLKCLRY

SEQ ID NO: 42971 - protein, 9 aa, Artificial Sequence
  Peptide Derived from Human Papillomavirus
NSLKCLRYR

SEQ ID NO: 42972 - protein, 11 aa, Artificial Sequence
  Peptide Derived from Human Papillomavirus
NSLKCLRYRLK

SEQ ID NO: 42973 - protein, 9 aa, Artificial Sequence
  Peptide Derived from Human Papillomavirus
NVAPIVHLK

SEQ ID NO: 42974 - protein, 9 aa, Artificial Sequence
  Peptide Derived from Human Papillomavirus
PALDNRTAR

SEQ ID NO: 42975 - protein, 9 aa, Artificial Sequence
  Peptide Derived from Human Papillomavirus
PSLLASKTK

SEQ ID NO: 42976 - protein, 8 aa, Artificial Sequence
  Peptide Derived from Human Papillomavirus
PSQIEHWK

SEQ ID NO: 42977 - protein, 11 aa, Artificial Sequence
  Peptide Derived from Human Papillomavirus
PSQIEHWKLIR

SEQ ID NO: 42978 - protein, 8 aa, Artificial Sequence
  Peptide Derived from Human Papillomavirus
QAAAKRRR

SEQ ID NO: 42979 - protein, 9 aa, Artificial Sequence
  Peptide Derived from Human Papillomavirus
QGETVTVQY

SEQ ID NO: 42980 - protein, 9 aa, Artificial Sequence
  Peptide Derived from Human Papillomavirus
QIEHWKLIR

SEQ ID NO: 42981 - protein, 9 aa, Artificial Sequence
  Peptide Derived from Human Papillomavirus
QMALETLSK

SEQ ID NO: 42982 - protein, 8 aa, Artificial Sequence
  Peptide Derived from Human Papillomavirus
QMFLGTVK

SEQ ID NO: 42983 - protein, 9 aa, Artificial Sequence
  Peptide Derived from Human Papillomavirus
QMGFSHLCH

SEQ ID NO: 42984 - protein, 10 aa, Artificial Sequence
  Peptide Derived from Human Papillomavirus
QVVPSLLASK

SEQ ID NO: 42985 - protein, 9 aa, Artificial Sequence
  Peptide Derived from Human Papillomavirus
RLKPYKELY

SEQ ID NO: 42986 - protein, 8 aa, Artificial Sequence
  Peptide Derived from Human Papillomavirus
RLNAVQEK

SEQ ID NO: 42987 - protein, 8 aa, Artificial Sequence
  Peptide Derived from Human Papillomavirus
RMECALLY

SEQ ID NO: 42988 - protein, 11 aa, Artificial Sequence
  Peptide Derived from Human Papillomavirus
RMECALLYTAK

SEQ ID NO: 42989 - protein, 9 aa, Artificial Sequence
  Peptide Derived from Human Papillomavirus
RTATNCTNK

SEQ ID NO: 42990 - protein, 11 aa, Artificial Sequence
  Peptide Derived from Human Papillomavirus
RTATNCTNKQR

SEQ ID NO: 42991 - protein, 10 aa, Artificial Sequence
  Peptide Derived from Human Papillomavirus
SARLNAVQEK

SEQ ID NO: 42992 - protein, 11 aa, Artificial Sequence
  Peptide Derived from Human Papillomavirus
SLEVWLCEPPK

SEQ ID NO: 42993 - protein, 8 aa, Artificial Sequence
  Peptide Derived from Human Papillomavirus
SLKCLRYR

SEQ ID NO: 42994 - protein, 10 aa, Artificial Sequence
  Peptide Derived from Human Papillomavirus
SLKCLRYRLK

SEQ ID NO: 42995 - protein, 8 aa, Artificial Sequence
  Peptide Derived from Human Papillomavirus
SLLASKTK

SEQ ID NO: 42996 - protein, 8 aa, Artificial Sequence
  Peptide Derived from Human Papillomavirus
SNSLKCLR

SEQ ID NO: 42997 - protein, 9 aa, Artificial Sequence
  Peptide Derived from Human Papillomavirus
SNSLKCLRY

SEQ ID NO: 42998 - protein, 10 aa, Artificial Sequence
  Peptide Derived from Human Papillomavirus
SNSLKCLRYR

SEQ ID NO: 42999 - protein, 8 aa, Artificial Sequence
  Peptide Derived from Human Papillomavirus
SNVAPIVH

SEQ ID NO: 43000 - protein, 10 aa, Artificial Sequence
  Peptide Derived from Human Papillomavirus
SNVAPIVHLK

SEQ ID NO: 43001 - protein, 8 aa, Artificial Sequence
  Peptide Derived from Human Papillomavirus
SSMSSTWH

SEQ ID NO: 43002 - protein, 9 aa, Artificial Sequence
  Peptide Derived from Human Papillomavirus
SSNVAPIVH

SEQ ID NO: 43003 - protein, 11 aa, Artificial Sequence
  Peptide Derived from Human Papillomavirus
SSNVAPIVHLK

SEQ ID NO: 43004 - protein, 11 aa, Artificial Sequence
  Peptide Derived from Human Papillomavirus
SSTWHWTSDNK

SEQ ID NO: 43005 - protein, 10 aa, Artificial Sequence
  Peptide Derived from Human Papillomavirus
STWHWTSDNK

SEQ ID NO: 43006 - protein, 11 aa, Artificial Sequence
  Peptide Derived from Human Papillomavirus
TADIQTDNDNR

SEQ ID NO: 43007 - protein, 9 aa, Artificial Sequence
  Peptide Derived from Human Papillomavirus
TAKQMGFSH

SEQ ID NO: 43008 - protein, 11 aa, Artificial Sequence
  Peptide Derived from Human Papillomavirus
TARTATNCTNK

SEQ ID NO: 43009 - protein, 8 aa, Artificial Sequence
  Peptide Derived from Human Papillomavirus
TATNCTNK

SEQ ID NO: 43010 - protein, 10 aa, Artificial Sequence
  Peptide Derived from Human Papillomavirus
TATNCTNKQR

SEQ ID NO: 43011 - protein, 8 aa, Artificial Sequence
  Peptide Derived from Human Papillomavirus
TCTMVTGK

SEQ ID NO: 43012 - protein, 11 aa, Artificial Sequence
  Peptide Derived from Human Papillomavirus
TCTMVTGKVDY

SEQ ID NO: 43013 - protein, 9 aa, Artificial Sequence
  Peptide Derived from Human Papillomavirus
TDLPSQIEH

SEQ ID NO: 43014 - protein, 11 aa, Artificial Sequence
  Peptide Derived from Human Papillomavirus
TDLPSQIEHWK

SEQ ID NO: 43015 - protein, 9 aa, Artificial Sequence
  Peptide Derived from Human Papillomavirus
TDTAQPLTK

SEQ ID NO: 43016 - protein, 10 aa, Artificial Sequence
  Peptide Derived from Human Papillomavirus
TGKVDYIGMY

SEQ ID NO: 43017 - protein, 11 aa, Artificial Sequence
  Peptide Derived from Human Papillomavirus
TGKVDYIGMYY

SEQ ID NO: 43018 - protein, 11 aa, Artificial Sequence
  Peptide Derived from Human Papillomavirus
TMDYTNWGEIY

SEQ ID NO: 43019 - protein, 9 aa, Artificial Sequence
  Peptide Derived from Human Papillomavirus
TMVTGKVDY

SEQ ID NO: 43020 - protein, 8 aa, Artificial Sequence
  Peptide Derived from Human Papillomavirus
TNCTNKQR

SEQ ID NO: 43021 - protein, 8 aa, Artificial Sequence
  Peptide Derived from Human Papillomavirus
TSDNKNSK

SEQ ID NO: 43022 - protein, 10 aa, Artificial Sequence
  Peptide Derived from Human Papillomavirus
TTDTAQPLTK

SEQ ID NO: 43023 - protein, 8 aa, Artificial Sequence
  Peptide Derived from Human Papillomavirus
TVQYDNDK

SEQ ID NO: 43024 - protein, 9 aa, Artificial Sequence
  Peptide Derived from Human Papillomavirus
TVQYDNDKK

SEQ ID NO: 43025 - protein, 10 aa, Artificial Sequence
  Peptide Derived from Human Papillomavirus
TVTVQYDNDK

SEQ ID NO: 43026 - protein, 11 aa, Artificial Sequence
  Peptide Derived from Human Papillomavirus
TVTVQYDNDKK

SEQ ID NO: 43027 - protein, 8 aa, Artificial Sequence
  Peptide Derived from Human Papillomavirus
VAPIVHLK

SEQ ID NO: 43028 - protein, 11 aa, Artificial Sequence
  Peptide Derived from Human Papillomavirus
VCSSNVAPIVH

SEQ ID NO: 43029 - protein, 8 aa, Artificial Sequence
  Peptide Derived from Human Papillomavirus
VDYIGMYY

SEQ ID NO: 43030 - protein, 10 aa, Artificial Sequence
  Peptide Derived from Human Papillomavirus
VDYIGMYYIH

SEQ ID NO: 43031 - protein, 11 aa, Artificial Sequence
  Peptide Derived from Human Papillomavirus
VTGKVDYIGMY

SEQ ID NO: 43032 - protein, 9 aa, Artificial Sequence
  Peptide Derived from Human Papillomavirus
VTVQYDNDK

SEQ ID NO: 43033 - protein, 10 aa, Artificial Sequence
  Peptide Derived from Human Papillomavirus
VTVQYDNDKK

SEQ ID NO: 43034 - protein, 9 aa, Artificial Sequence
  Peptide Derived from Human Papillomavirus
VVPSLLASK

SEQ ID NO: 43035 - protein, 11 aa, Artificial Sequence
  Peptide Derived from Human Papillomavirus
VVPSLLASKTK

SEQ ID NO: 43036 - protein, 10 aa, Artificial Sequence
  Peptide Derived from Human Papillomavirus
WLCEPPKCFK

SEQ ID NO: 43037 - protein, 11 aa, Artificial Sequence
  Peptide Derived from Human Papillomavirus
WLCEPPKCFKK

SEQ ID NO: 43038 - protein, 9 aa, Artificial Sequence
  Peptide Derived from Human Papillomavirus
WTSDNKNSK

SEQ ID NO: 43039 - protein, 11 aa, Artificial Sequence
  Peptide Derived from Human Papillomavirus
YDNDKKNTMDY

SEQ ID NO: 43040 - protein, 8 aa, Artificial Sequence
  Peptide Derived from Human Papillomavirus
YFKEDAAK

SEQ ID NO: 43041 - protein, 9 aa, Artificial Sequence
  Peptide Derived from Human Papillomavirus
YFKEDAAKY

SEQ ID NO: 43042 - protein, 11 aa, Artificial Sequence
  Peptide Derived from Human Papillomavirus
YFKEDAAKYSK

SEQ ID NO: 43043 - protein, 11 aa, Artificial Sequence
  Peptide Derived from Human Papillomavirus
YFKYFKEDAAK

SEQ ID NO: 43044 - protein, 8 aa, Artificial Sequence
  Peptide Derived from Human Papillomavirus
YIGMYYIH

SEQ ID NO: 43045 - protein, 9 aa, Artificial Sequence
  Peptide Derived from Human Papillomavirus
YIHNCEKVY

SEQ ID NO: 43046 - protein, 11 aa, Artificial Sequence
  Peptide Derived from Human Papillomavirus
YIHNCEKVYFK

SEQ ID NO: 43047 - protein, 10 aa, Artificial Sequence
  Peptide Derived from Human Papillomavirus
YSKTQMWEVH

SEQ ID NO: 43048 - protein, 9 aa, Artificial Sequence
  Peptide Derived from Human Papillomavirus
YSSMSSTWH

SEQ ID NO: 43049 - protein, 10 aa, Artificial Sequence
  Peptide Derived from Human Papillomavirus
YTAKQMGFSH

SEQ ID NO: 43050 - protein, 8 aa, Artificial Sequence
  Peptide Derived from Human Papillomavirus
YTNWGEIY

SEQ ID NO: 43051 - protein, 8 aa, Artificial Sequence
  Peptide Derived from Human Papillomavirus
CINFHAQH

SEQ ID NO: 43052 - protein, 8 aa, Artificial Sequence
  Peptide Derived from Human Papillomavirus
FCYLLFLY

SEQ ID NO: 43053 - protein, 9 aa, Artificial Sequence
  Peptide Derived from Human Papillomavirus
FFCYLLFLY

SEQ ID NO: 43054 - protein, 9 aa, Artificial Sequence
  Peptide Derived from Human Papillomavirus
FLCLSLLLR

SEQ ID NO: 43055 - protein, 10 aa, Artificial Sequence
  Peptide Derived from Human Papillomavirus
GSPLKIFFCY

SEQ ID NO: 43056 - protein, 10 aa, Artificial Sequence
  Peptide Derived from Human Papillomavirus
IFFCYLLFLY

SEQ ID NO: 43057 - protein, 11 aa, Artificial Sequence
  Peptide Derived from Human Papillomavirus
ILFLCLSLLLR

SEQ ID NO: 43058 - protein, 11 aa, Artificial Sequence
  Peptide Derived from Human Papillomavirus
KIFFCYLLFLY

SEQ ID NO: 43059 - protein, 8 aa, Artificial Sequence
  Peptide Derived from Human Papillomavirus
LCLSLLLR

SEQ ID NO: 43060 - protein, 10 aa, Artificial Sequence
  Peptide Derived from Human Papillomavirus
LFLCLSLLLR

SEQ ID NO: 43061 - protein, 8 aa, Artificial Sequence
  Peptide Derived from Human Papillomavirus
LILSISTY

SEQ ID NO: 43062 - protein, 11 aa, Artificial Sequence
  Peptide Derived from Human Papillomavirus
LLWVFVGSPLK

SEQ ID NO: 43063 - protein, 9 aa, Artificial Sequence
  Peptide Derived from Human Papillomavirus
MCINFHAQH

SEQ ID NO: 43064 - protein, 10 aa, Artificial Sequence
  Peptide Derived from Human Papillomavirus
MMCINFHAQH

SEQ ID NO: 43065 - protein, 9 aa, Artificial Sequence
  Peptide Derived from Human Papillomavirus
PLILSISTY

SEQ ID NO: 43066 - protein, 8 aa, Artificial Sequence
  Peptide Derived from Human Papillomavirus
PLKIFFCY

SEQ ID NO: 43067 - protein, 8 aa, Artificial Sequence
  Peptide Derived from Human Papillomavirus
PMMCINFH

SEQ ID NO: 43068 - protein, 11 aa, Artificial Sequence
  Peptide Derived from Human Papillomavirus
PMMCINFHAQH

SEQ ID NO: 43069 - protein, 8 aa, Artificial Sequence
  Peptide Derived from Human Papillomavirus
VFVGSPLK

SEQ ID NO: 43070 - protein, 11 aa, Artificial Sequence
  Peptide Derived from Human Papillomavirus
VGSPLKIFFCY

SEQ ID NO: 43071 - protein, 9 aa, Artificial Sequence
  Peptide Derived from Human Papillomavirus
WVFVGSPLK

SEQ ID NO: 43072 - protein, 10 aa, Artificial Sequence
  Peptide Derived from Human Papillomavirus
YLPMMCINFH

SEQ ID NO: 43073 - protein, 8 aa, Artificial Sequence
  Peptide Derived from Human Papillomavirus
AACWRSRR

SEQ ID NO: 43074 - protein, 9 aa, Artificial Sequence
  Peptide Derived from Human Papillomavirus
AACWRSRRR

SEQ ID NO: 43075 - protein, 8 aa, Artificial Sequence
  Peptide Derived from Human Papillomavirus
ACWRSRRR

SEQ ID NO: 43076 - protein, 8 aa, Artificial Sequence
  Peptide Derived from Human Papillomavirus
ADLTVVYR

SEQ ID NO: 43077 - protein, 9 aa, Artificial Sequence
  Peptide Derived from Human Papillomavirus
AFADLTVVY

SEQ ID NO: 43078 - protein, 10 aa, Artificial Sequence
  Peptide Derived from Human Papillomavirus
AFADLTVVYR

SEQ ID NO: 43079 - protein, 9 aa, Artificial Sequence
  Peptide Derived from Human Papillomavirus
AGRCAACWR

SEQ ID NO: 43080 - protein, 11 aa, Artificial Sequence
  Peptide Derived from Human Papillomavirus
AGRCAACWRSR

SEQ ID NO: 43081 - protein, 8 aa, Artificial Sequence
  Peptide Derived from Human Papillomavirus
CAACWRSR

SEQ ID NO: 43082 - protein, 9 aa, Artificial Sequence
  Peptide Derived from Human Papillomavirus
CAACWRSRR

SEQ ID NO: 43083 - protein, 10 aa, Artificial Sequence
  Peptide Derived from Human Papillomavirus
CAACWRSRRR

SEQ ID NO: 43084 - protein, 11 aa, Artificial Sequence
  Peptide Derived from Human Papillomavirus
CLRFLSKISEY

SEQ ID NO: 43085 - protein, 10 aa, Artificial Sequence
  Peptide Derived from Human Papillomavirus
CVECKKPLQR

SEQ ID NO: 43086 - protein, 11 aa, Artificial Sequence
  Peptide Derived from Human Papillomavirus
DFAFADLTVVY

SEQ ID NO: 43087 - protein, 11 aa, Artificial Sequence
  Peptide Derived from Human Papillomavirus
DLCQALETTIH

SEQ ID NO: 43088 - protein, 10 aa, Artificial Sequence
  Peptide Derived from Human Papillomavirus
DTEEKPRTLH

SEQ ID NO: 43089 - protein, 8 aa, Artificial Sequence
  Peptide Derived from Human Papillomavirus
ECKKPLQR

SEQ ID NO: 43090 - protein, 9 aa, Artificial Sequence
  Peptide Derived from Human Papillomavirus
EGNPFGICK

SEQ ID NO: 43091 - protein, 11 aa, Artificial Sequence
  Peptide Derived from Human Papillomavirus
EILIRCIICQR

SEQ ID NO: 43092 - protein, 8 aa, Artificial Sequence
  Peptide Derived from Human Papillomavirus
ELQCVECK

SEQ ID NO: 43093 - protein, 9 aa, Artificial Sequence
  Peptide Derived from Human Papillomavirus
ELQCVECKK

SEQ ID NO: 43094 - protein, 8 aa, Artificial Sequence
  Peptide Derived from Human Papillomavirus
FADLTVVY

SEQ ID NO: 43095 - protein, 9 aa, Artificial Sequence
  Peptide Derived from Human Papillomavirus
FADLTVVYR

SEQ ID NO: 43096 - protein, 10 aa, Artificial Sequence
  Peptide Derived from Human Papillomavirus
FAFADLTVVY

SEQ ID NO: 43097 - protein, 11 aa, Artificial Sequence
  Peptide Derived from Human Papillomavirus
FAFADLTVVYR

SEQ ID NO: 43098 - protein, 9 aa, Artificial Sequence
  Peptide Derived from Human Papillomavirus
FGICKLCLR

SEQ ID NO: 43099 - protein, 8 aa, Artificial Sequence
  Peptide Derived from Human Papillomavirus
FLSKISEY

SEQ ID NO: 43100 - protein, 9 aa, Artificial Sequence
  Peptide Derived from Human Papillomavirus
FLSKISEYR

SEQ ID NO: 43101 - protein, 10 aa, Artificial Sequence
  Peptide Derived from Human Papillomavirus
FLSKISEYRH

SEQ ID NO: 43102 - protein, 11 aa, Artificial Sequence
  Peptide Derived from Human Papillomavirus
FLSKISEYRHY

SEQ ID NO: 43103 - protein, 8 aa, Artificial Sequence
  Peptide Derived from Human Papillomavirus
GICKLCLR

SEQ ID NO: 43104 - protein, 8 aa, Artificial Sequence
  Peptide Derived from Human Papillomavirus
GNPFGICK

SEQ ID NO: 43105 - protein, 9 aa, Artificial Sequence
  Peptide Derived from Human Papillomavirus
GNTLEQTVK

SEQ ID NO: 43106 - protein, 10 aa, Artificial Sequence
  Peptide Derived from Human Papillomavirus
GNTLEQTVKK

SEQ ID NO: 43107 - protein, 11 aa, Artificial Sequence
  Peptide Derived from Human Papillomavirus
HNIELQCVECK

SEQ ID NO: 43108 - protein, 10 aa, Artificial Sequence
  Peptide Derived from Human Papillomavirus
HNISGRWAGR

SEQ ID NO: 43109 - protein, 9 aa, Artificial Sequence
  Peptide Derived from Human Papillomavirus
HVDLNKRFH

SEQ ID NO: 43110 - protein, 11 aa, Artificial Sequence
  Peptide Derived from Human Papillomavirus
ICKLCLRFLSK

SEQ ID NO: 43111 - protein, 11 aa, Artificial Sequence
  Peptide Derived from Human Papillomavirus
ICQRPLCPQEK

SEQ ID NO: 43112 - protein, 10 aa, Artificial Sequence
  Peptide Derived from Human Papillomavirus
ILIRCIICQR

SEQ ID NO: 43113 - protein, 9 aa, Artificial Sequence
  Peptide Derived from Human Papillomavirus
ISEYRHYNY

SEQ ID NO: 43114 - protein, 8 aa, Artificial Sequence
  Peptide Derived from Human Papillomavirus
ISGRWAGR

SEQ ID NO: 43115 - protein, 8 aa, Artificial Sequence
  Peptide Derived from Human Papillomavirus
KISEYRHY

SEQ ID NO: 43116 - protein, 10 aa, Artificial Sequence
  Peptide Derived from Human Papillomavirus
KISEYRHYNY

SEQ ID NO: 43117 - protein, 9 aa, Artificial Sequence
  Peptide Derived from Human Papillomavirus
KLCLRFLSK

SEQ ID NO: 43118 - protein, 8 aa, Artificial Sequence
  Peptide Derived from Human Papillomavirus
LCLRFLSK

SEQ ID NO: 43119 - protein, 8 aa, Artificial Sequence
  Peptide Derived from Human Papillomavirus
LCPQEKKR

SEQ ID NO: 43120 - protein, 9 aa, Artificial Sequence
  Peptide Derived from Human Papillomavirus
LCPQEKKRH

SEQ ID NO: 43121 - protein, 10 aa, Artificial Sequence
  Peptide Derived from Human Papillomavirus
LCQALETTIH

SEQ ID NO: 43122 - protein, 9 aa, Artificial Sequence
  Peptide Derived from Human Papillomavirus
LIRCIICQR

SEQ ID NO: 43123 - protein, 11 aa, Artificial Sequence
  Peptide Derived from Human Papillomavirus
LNKRFHNISGR

SEQ ID NO: 43124 - protein, 8 aa, Artificial Sequence
  Peptide Derived from Human Papillomavirus
LSKISEYR

SEQ ID NO: 43125 - protein, 9 aa, Artificial Sequence
  Peptide Derived from Human Papillomavirus
LSKISEYRH

SEQ ID NO: 43126 - protein, 10 aa, Artificial Sequence
  Peptide Derived from Human Papillomavirus
LSKISEYRHY

SEQ ID NO: 43127 - protein, 8 aa, Artificial Sequence
  Peptide Derived from Human Papillomavirus
MFQDTEEK

SEQ ID NO: 43128 - protein, 10 aa, Artificial Sequence
  Peptide Derived from Human Papillomavirus
MFQDTEEKPR

SEQ ID NO: 43129 - protein, 10 aa, Artificial Sequence
  Peptide Derived from Human Papillomavirus
NIELQCVECK

SEQ ID NO: 43130 - protein, 11 aa, Artificial Sequence
  Peptide Derived from Human Papillomavirus
NIELQCVECKK

SEQ ID NO: 43131 - protein, 9 aa, Artificial Sequence
  Peptide Derived from Human Papillomavirus
NISGRWAGR

SEQ ID NO: 43132 - protein, 8 aa, Artificial Sequence
  Peptide Derived from Human Papillomavirus
NTLEQTVK

SEQ ID NO: 43133 - protein, 9 aa, Artificial Sequence
  Peptide Derived from Human Papillomavirus
NTLEQTVKK

SEQ ID NO: 43134 - protein, 10 aa, Artificial Sequence
  Peptide Derived from Human Papillomavirus
PFGICKLCLR

SEQ ID NO: 43135 - protein, 8 aa, Artificial Sequence
  Peptide Derived from Human Papillomavirus
PLCPQEKK

SEQ ID NO: 43136 - protein, 9 aa, Artificial Sequence
  Peptide Derived from Human Papillomavirus
PLCPQEKKR

SEQ ID NO: 43137 - protein, 10 aa, Artificial Sequence
  Peptide Derived from Human Papillomavirus
PLCPQEKKRH

SEQ ID NO: 43138 - protein, 8 aa, Artificial Sequence
  Peptide Derived from Human Papillomavirus
PLNEILIR

SEQ ID NO: 43139 - protein, 8 aa, Artificial Sequence
  Peptide Derived from Human Papillomavirus
PLQRSEVY

SEQ ID NO: 43140 - protein, 8 aa, Artificial Sequence
  Peptide Derived from Human Papillomavirus
QALETTIH

SEQ ID NO: 43141 - protein, 11 aa, Artificial Sequence
  Peptide Derived from Human Papillomavirus
QCVECKKPLQR

SEQ ID NO: 43142 - protein, 8 aa, Artificial Sequence
  Peptide Derived from Human Papillomavirus
QDTEEKPR

SEQ ID NO: 43143 - protein, 11 aa, Artificial Sequence
  Peptide Derived from Human Papillomavirus
QDTEEKPRTLH

SEQ ID NO: 43144 - protein, 9 aa, Artificial Sequence
  Peptide Derived from Human Papillomavirus
RCAACWRSR

SEQ ID NO: 43145 - protein, 10 aa, Artificial Sequence
  Peptide Derived from Human Papillomavirus
RCAACWRSRR

SEQ ID NO: 43146 - protein, 11 aa, Artificial Sequence
  Peptide Derived from Human Papillomavirus
RCAACWRSRRR

SEQ ID NO: 43147 - protein, 8 aa, Artificial Sequence
  Peptide Derived from Human Papillomavirus
RFHNISGR

SEQ ID NO: 43148 - protein, 9 aa, Artificial Sequence
  Peptide Derived from Human Papillomavirus
RFLSKISEY

SEQ ID NO: 43149 - protein, 10 aa, Artificial Sequence
  Peptide Derived from Human Papillomavirus
RFLSKISEYR

SEQ ID NO: 43150 - protein, 11 aa, Artificial Sequence
  Peptide Derived from Human Papillomavirus
RFLSKISEYRH

SEQ ID NO: 43151 - protein, 8 aa, Artificial Sequence
  Peptide Derived from Human Papillomavirus
TLEQTVKK

SEQ ID NO: 43152 - protein, 8 aa, Artificial Sequence
  Peptide Derived from Human Papillomavirus
VDLNKRFH

SEQ ID NO: 43153 - protein, 10 aa, Artificial Sequence
  Peptide Derived from Human Papillomavirus
WAGRCAACWR

SEQ ID NO: 43154 - protein, 10 aa, Artificial Sequence
  Peptide Derived from Human Papillomavirus
YGNTLEQTVK

SEQ ID NO: 43155 - protein, 11 aa, Artificial Sequence
  Peptide Derived from Human Papillomavirus
YGNTLEQTVKK

SEQ ID NO: 43156 - protein, 10 aa, Artificial Sequence
  Peptide Derived from Human Papillomavirus
ADYYIVTCCH

SEQ ID NO: 43157 - protein, 10 aa, Artificial Sequence
  Peptide Derived from Human Papillomavirus
CCHTCNTTVR

SEQ ID NO: 43158 - protein, 10 aa, Artificial Sequence
  Peptide Derived from Human Papillomavirus
CVNSTASDLR

SEQ ID NO: 43159 - protein, 11 aa, Artificial Sequence
  Peptide Derived from Human Papillomavirus
DGQAQPATADY

SEQ ID NO: 43160 - protein, 10 aa, Artificial Sequence
  Peptide Derived from Human Papillomavirus
DLYPEPTDLY

SEQ ID NO: 43161 - protein, 11 aa, Artificial Sequence
  Peptide Derived from Human Papillomavirus
DSSDEDEGLDR

SEQ ID NO: 43162 - protein, 8 aa, Artificial Sequence
  Peptide Derived from Human Papillomavirus
HTCNTTVR

SEQ ID NO: 43163 - protein, 11 aa, Artificial Sequence
  Peptide Derived from Human Papillomavirus
LCVNSTASDLR

SEQ ID NO: 43164 - protein, 11 aa, Artificial Sequence
  Peptide Derived from Human Papillomavirus
LDLYPEPTDLY

SEQ ID NO: 43165 - protein, 8 aa, Artificial Sequence
  Peptide Derived from Human Papillomavirus
NSTASDLR

SEQ ID NO: 43166 - protein, 11 aa, Artificial Sequence
  Peptide Derived from Human Papillomavirus
PTLKEYVLDLY

SEQ ID NO: 43167 - protein, 9 aa, Artificial Sequence
  Peptide Derived from Human Papillomavirus
QAQPATADY

SEQ ID NO: 43168 - protein, 10 aa, Artificial Sequence
  Peptide Derived from Human Papillomavirus
QAQPATADYY

SEQ ID NO: 43169 - protein, 8 aa, Artificial Sequence
  Peptide Derived from Human Papillomavirus
RGHKPTLK

SEQ ID NO: 43170 - protein, 10 aa, Artificial Sequence
  Peptide Derived from Human Papillomavirus
RGHKPTLKEY

SEQ ID NO: 43171 - protein, 9 aa, Artificial Sequence
  Peptide Derived from Human Papillomavirus
SDEDEGLDR

SEQ ID NO: 43172 - protein, 10 aa, Artificial Sequence
  Peptide Derived from Human Papillomavirus
SSDEDEGLDR

SEQ ID NO: 43173 - protein, 11 aa, Artificial Sequence
  Peptide Derived from Human Papillomavirus
TADYYIVTCCH

SEQ ID NO: 43174 - protein, 11 aa, Artificial Sequence
  Peptide Derived from Human Papillomavirus
TCCHTCNTTVR

SEQ ID NO: 43175 - protein, 10 aa, Artificial Sequence
  Peptide Derived from Human Papillomavirus
TLKEYVLDLY

SEQ ID NO: 43176 - protein, 9 aa, Artificial Sequence
  Peptide Derived from Human Papillomavirus
VNSTASDLR

SEQ ID NO: 43177 - protein, 9 aa, Artificial Sequence
  Peptide Derived from Human Papillomavirus
ACVGLEIGR

SEQ ID NO: 43178 - protein, 10 aa, Artificial Sequence
  Peptide Derived from Human Papillomavirus
ADLDQFPLGR

SEQ ID NO: 43179 - protein, 11 aa, Artificial Sequence
  Peptide Derived from Human Papillomavirus
ADLDQFPLGRK

SEQ ID NO: 43180 - protein, 11 aa, Artificial Sequence
  Peptide Derived from Human Papillomavirus
ADNRECLSMDY

SEQ ID NO: 43181 - protein, 8 aa, Artificial Sequence
  Peptide Derived from Human Papillomavirus
AGLKAKPK

SEQ ID NO: 43182 - protein, 10 aa, Artificial Sequence
  Peptide Derived from Human Papillomavirus
AGLKAKPKLK

SEQ ID NO: 43183 - protein, 11 aa, Artificial Sequence
  Peptide Derived from Human Papillomavirus
AGLKAKPKLKR

SEQ ID NO: 43184 - protein, 11 aa, Artificial Sequence
  Peptide Derived from Human Papillomavirus
AGSSRLLAVGH

SEQ ID NO: 43185 - protein, 11 aa, Artificial Sequence
  Peptide Derived from Human Papillomavirus
AITCQKTVPPK

SEQ ID NO: 43186 - protein, 8 aa, Artificial Sequence
  Peptide Derived from Human Papillomavirus
ASLQDTYR

SEQ ID NO: 43187 - protein, 10 aa, Artificial Sequence
  Peptide Derived from Human Papillomavirus
AVGHPYFSIK

SEQ ID NO: 43188 - protein, 9 aa, Artificial Sequence
  Peptide Derived from Human Papillomavirus
AVPDDLYIK

SEQ ID NO: 43189 - protein, 10 aa, Artificial Sequence
  Peptide Derived from Human Papillomavirus
CGSTCKYPDY

SEQ ID NO: 43190 - protein, 11 aa, Artificial Sequence
  Peptide Derived from Human Papillomavirus
CMDFKTLQANK

SEQ ID NO: 43191 - protein, 10 aa, Artificial Sequence
  Peptide Derived from Human Papillomavirus
CTQVTSDSTY

SEQ ID NO: 43192 - protein, 11 aa, Artificial Sequence
  Peptide Derived from Human Papillomavirus
CTQVTSDSTYK

SEQ ID NO: 43193 - protein, 8 aa, Artificial Sequence
  Peptide Derived from Human Papillomavirus
CVGLEIGR

SEQ ID NO: 43194 - protein, 8 aa, Artificial Sequence
  Peptide Derived from Human Papillomavirus
DDTETGNK

SEQ ID NO: 43195 - protein, 9 aa, Artificial Sequence
  Peptide Derived from Human Papillomavirus
DDTETGNKY

SEQ ID NO: 43196 - protein, 9 aa, Artificial Sequence
  Peptide Derived from Human Papillomavirus
DFKTLQANK

SEQ ID NO: 43197 - protein, 8 aa, Artificial Sequence
  Peptide Derived from Human Papillomavirus
DICGSTCK

SEQ ID NO: 43198 - protein, 9 aa, Artificial Sequence
  Peptide Derived from Human Papillomavirus
DICGSTCKY

SEQ ID NO: 43199 - protein, 9 aa, Artificial Sequence
  Peptide Derived from Human Papillomavirus
DLDQFPLGR

SEQ ID NO: 43200 - protein, 10 aa, Artificial Sequence
  Peptide Derived from Human Papillomavirus
DLDQFPLGRK

SEQ ID NO: 43201 - protein, 10 aa, Artificial Sequence
  Peptide Derived from Human Papillomavirus
DLQFVFQLCK

SEQ ID NO: 43202 - protein, 10 aa, Artificial Sequence
  Peptide Derived from Human Papillomavirus
DNRECLSMDY

SEQ ID NO: 43203 - protein, 11 aa, Artificial Sequence
  Peptide Derived from Human Papillomavirus
DNRECLSMDYK

SEQ ID NO: 43204 - protein, 8 aa, Artificial Sequence
  Peptide Derived from Human Papillomavirus
DSLFFFLR

SEQ ID NO: 43205 - protein, 9 aa, Artificial Sequence
  Peptide Derived from Human Papillomavirus
DSLFFFLRR

SEQ ID NO: 43206 - protein, 10 aa, Artificial Sequence
  Peptide Derived from Human Papillomavirus
DSTYKNENFK

SEQ ID NO: 43207 - protein, 8 aa, Artificial Sequence
  Peptide Derived from Human Papillomavirus
DTETGNKY

SEQ ID NO: 43208 - protein, 10 aa, Artificial Sequence
  Peptide Derived from Human Papillomavirus
DTGFGCMDFK

SEQ ID NO: 43209 - protein, 11 aa, Artificial Sequence
  Peptide Derived from Human Papillomavirus
DTSFYNPDTQR

SEQ ID NO: 43210 - protein, 8 aa, Artificial Sequence
  Peptide Derived from Human Papillomavirus
EAVPDDLY

SEQ ID NO: 43211 - protein, 10 aa, Artificial Sequence
  Peptide Derived from Human Papillomavirus
EAVPDDLYIK

SEQ ID NO: 43212 - protein, 8 aa, Artificial Sequence
  Peptide Derived from Human Papillomavirus
ECLSMDYK

SEQ ID NO: 43213 - protein, 8 aa, Artificial Sequence
  Peptide Derived from Human Papillomavirus
ENFKEYIR

SEQ ID NO: 43214 - protein, 9 aa, Artificial Sequence
  Peptide Derived from Human Papillomavirus
ENFKEYIRH

SEQ ID NO: 43215 - protein, 9 aa, Artificial Sequence
  Peptide Derived from Human Papillomavirus
ESQLFNKPY

SEQ ID NO: 43216 - protein, 9 aa, Artificial Sequence
  Peptide Derived from Human Papillomavirus
FDDTETGNK

SEQ ID NO: 43217 - protein, 10 aa, Artificial Sequence
  Peptide Derived from Human Papillomavirus
FDDTETGNKY

SEQ ID NO: 43218 - protein, 11 aa, Artificial Sequence
  Peptide Derived from Human Papillomavirus
FFLRREQMFVR

SEQ ID NO: 43219 - protein, 9 aa, Artificial Sequence
  Peptide Derived from Human Papillomavirus
FGFPDTSFY

SEQ ID NO: 43220 - protein, 8 aa, Artificial Sequence
  Peptide Derived from Human Papillomavirus
FLLQAGLK

SEQ ID NO: 43221 - protein, 10 aa, Artificial Sequence
  Peptide Derived from Human Papillomavirus
FLLQAGLKAK

SEQ ID NO: 43222 - protein, 10 aa, Artificial Sequence
  Peptide Derived from Human Papillomavirus
FLRREQMFVR

SEQ ID NO: 43223 - protein, 11 aa, Artificial Sequence
  Peptide Derived from Human Papillomavirus
FLRREQMFVRH

SEQ ID NO: 43224 - protein, 9 aa, Artificial Sequence
  Peptide Derived from Human Papillomavirus
FNKPYWLQR

SEQ ID NO: 43225 - protein, 10 aa, Artificial Sequence
  Peptide Derived from Human Papillomavirus
FSIKNPTNAK

SEQ ID NO: 43226 - protein, 11 aa, Artificial Sequence
  Peptide Derived from Human Papillomavirus
FSIKNPTNAKK

SEQ ID NO: 43227 - protein, 8 aa, Artificial Sequence
  Peptide Derived from Human Papillomavirus
FVRHFFNR

SEQ ID NO: 43228 - protein, 11 aa, Artificial Sequence
  Peptide Derived from Human Papillomavirus
FVTSQAITCQK

SEQ ID NO: 43229 - protein, 9 aa, Artificial Sequence
  Peptide Derived from Human Papillomavirus
FVTVVDTTR

SEQ ID NO: 43230 - protein, 9 aa, Artificial Sequence
  Peptide Derived from Human Papillomavirus
GCKPPTGEH

SEQ ID NO: 43231 - protein, 9 aa, Artificial Sequence
  Peptide Derived from Human Papillomavirus
GDSLFFFLR

SEQ ID NO: 43232 - protein, 10 aa, Artificial Sequence
  Peptide Derived from Human Papillomavirus
GDSLFFFLRR

SEQ ID NO: 43233 - protein, 8 aa, Artificial Sequence
  Peptide Derived from Human Papillomavirus
GFGCMDFK

SEQ ID NO: 43234 - protein, 8 aa, Artificial Sequence
  Peptide Derived from Human Papillomavirus
GFPDTSFY

SEQ ID NO: 43235 - protein, 10 aa, Artificial Sequence
  Peptide Derived from Human Papillomavirus
GISGHPLLNK

SEQ ID NO: 43236 - protein, 9 aa, Artificial Sequence
  Peptide Derived from Human Papillomavirus
GLKAKPKLK

SEQ ID NO: 43237 - protein, 10 aa, Artificial Sequence
  Peptide Derived from Human Papillomavirus
GLKAKPKLKR

SEQ ID NO: 43238 - protein, 8 aa, Artificial Sequence
  Peptide Derived from Human Papillomavirus
GLQYRVFR

SEQ ID NO: 43239 - protein, 10 aa, Artificial Sequence
  Peptide Derived from Human Papillomavirus
GLQYRVFRVR

SEQ ID NO: 43240 - protein, 10 aa, Artificial Sequence
  Peptide Derived from Human Papillomavirus
GSSRLLAVGH

SEQ ID NO: 43241 - protein, 9 aa, Artificial Sequence
  Peptide Derived from Human Papillomavirus
GSTCKYPDY

SEQ ID NO: 43242 - protein, 11 aa, Artificial Sequence
  Peptide Derived from Human Papillomavirus
GSTCKYPDYLK

SEQ ID NO: 43243 - protein, 8 aa, Artificial Sequence
  Peptide Derived from Human Papillomavirus
ICGSTCKY

SEQ ID NO: 43244 - protein, 11 aa, Artificial Sequence
  Peptide Derived from Human Papillomavirus
ICGSTCKYPDY

SEQ ID NO: 43245 - protein, 9 aa, Artificial Sequence
  Peptide Derived from Human Papillomavirus
IDICGSTCK

SEQ ID NO: 43246 - protein, 10 aa, Artificial Sequence
  Peptide Derived from Human Papillomavirus
IDICGSTCKY

SEQ ID NO: 43247 - protein, 9 aa, Artificial Sequence
  Peptide Derived from Human Papillomavirus
ISGHPLLNK

SEQ ID NO: 43248 - protein, 10 aa, Artificial Sequence
  Peptide Derived from Human Papillomavirus
ITCQKTVPPK

SEQ ID NO: 43249 - protein, 8 aa, Artificial Sequence
  Peptide Derived from Human Papillomavirus
KAKPKLKR

SEQ ID NO: 43250 - protein, 10 aa, Artificial Sequence
  Peptide Derived from Human Papillomavirus
KFDDTETGNK

SEQ ID NO: 43251 - protein, 11 aa, Artificial Sequence
  Peptide Derived from Human Papillomavirus
KFDDTETGNKY

SEQ ID NO: 43252 - protein, 10 aa, Artificial Sequence
  Peptide Derived from Human Papillomavirus
KFGFPDTSFY

SEQ ID NO: 43253 - protein, 9 aa, Artificial Sequence
  Peptide Derived from Human Papillomavirus
KFLLQAGLK

SEQ ID NO: 43254 - protein, 11 aa, Artificial Sequence
  Peptide Derived from Human Papillomavirus
KFLLQAGLKAK

SEQ ID NO: 43255 - protein, 11 aa, Artificial Sequence
  Peptide Derived from Human Papillomavirus
KLKRAAPTSTR

SEQ ID NO: 43256 - protein, 8 aa, Artificial Sequence
  Peptide Derived from Human Papillomavirus
KNENFKEY

SEQ ID NO: 43257 - protein, 10 aa, Artificial Sequence
  Peptide Derived from Human Papillomavirus
KNENFKEYIR

SEQ ID NO: 43258 - protein, 11 aa, Artificial Sequence
  Peptide Derived from Human Papillomavirus
KNENFKEYIRH

SEQ ID NO: 43259 - protein, 8 aa, Artificial Sequence
  Peptide Derived from Human Papillomavirus
KNPTNAKK

SEQ ID NO: 43260 - protein, 8 aa, Artificial Sequence
  Peptide Derived from Human Papillomavirus
KTVPPKEK

SEQ ID NO: 43261 - protein, 8 aa, Artificial Sequence
  Peptide Derived from Human Papillomavirus
KVSGLQYR

SEQ ID NO: 43262 - protein, 11 aa, Artificial Sequence
  Peptide Derived from Human Papillomavirus
KVSGLQYRVFR

SEQ ID NO: 43263 - protein, 11 aa, Artificial Sequence
  Peptide Derived from Human Papillomavirus
KVTLTAEVMTY

SEQ ID NO: 43264 - protein, 8 aa, Artificial Sequence
  Peptide Derived from Human Papillomavirus
KVVSTDEY

SEQ ID NO: 43265 - protein, 11 aa, Artificial Sequence
  Peptide Derived from Human Papillomavirus
KVVSTDEYVSR

SEQ ID NO: 43266 - protein, 11 aa, Artificial Sequence
  Peptide Derived from Human Papillomavirus
LAVGHPYFSIK

SEQ ID NO: 43267 - protein, 11 aa, Artificial Sequence
  Peptide Derived from Human Papillomavirus
LCTQVTSDSTY

SEQ ID NO: 43268 - protein, 8 aa, Artificial Sequence
  Peptide Derived from Human Papillomavirus
LDQFPLGR

SEQ ID NO: 43269 - protein, 9 aa, Artificial Sequence
  Peptide Derived from Human Papillomavirus
LDQFPLGRK

SEQ ID NO: 43270 - protein, 10 aa, Artificial Sequence
  Peptide Derived from Human Papillomavirus
LFNKPYWLQR

SEQ ID NO: 43271 - protein, 10 aa, Artificial Sequence
  Peptide Derived from Human Papillomavirus
LGCKPPTGEH

SEQ ID NO: 43272 - protein, 10 aa, Artificial Sequence
  Peptide Derived from Human Papillomavirus
LGEAVPDDLY

SEQ ID NO: 43273 - protein, 8 aa, Artificial Sequence
  Peptide Derived from Human Papillomavirus
LGVGISGH

SEQ ID NO: 43274 - protein, 8 aa, Artificial Sequence
  Peptide Derived from Human Papillomavirus
LLAVGHPY

SEQ ID NO: 43275 - protein, 11 aa, Artificial Sequence
  Peptide Derived from Human Papillomavirus
LLGCKPPTGEH

SEQ ID NO: 43276 - protein, 9 aa, Artificial Sequence
  Peptide Derived from Human Papillomavirus
LLQAGLKAK

SEQ ID NO: 43277 - protein, 11 aa, Artificial Sequence
  Peptide Derived from Human Papillomavirus
LLQAGLKAKPK

SEQ ID NO: 43278 - protein, 11 aa, Artificial Sequence
  Peptide Derived from Human Papillomavirus
LLVPKVSGLQY

SEQ ID NO: 43279 - protein, 8 aa, Artificial Sequence
  Peptide Derived from Human Papillomavirus
LTAEVMTY

SEQ ID NO: 43280 - protein, 10 aa, Artificial Sequence
  Peptide Derived from Human Papillomavirus
LTAEVMTYIH

SEQ ID NO: 43281 - protein, 10 aa, Artificial Sequence
  Peptide Derived from Human Papillomavirus
LVPKVSGLQY

SEQ ID NO: 43282 - protein, 11 aa, Artificial Sequence
  Peptide Derived from Human Papillomavirus
LVPKVSGLQYR

SEQ ID NO: 43283 - protein, 10 aa, Artificial Sequence
  Peptide Derived from Human Papillomavirus
MDFKTLQANK

SEQ ID NO: 43284 - protein, 9 aa, Artificial Sequence
  Peptide Derived from Human Papillomavirus
MFVRHFFNR

SEQ ID NO: 43285 - protein, 11 aa, Artificial Sequence
  Peptide Derived from Human Papillomavirus
MVTSESQLFNK

SEQ ID NO: 43286 - protein, 9 aa, Artificial Sequence
  Peptide Derived from Human Papillomavirus
NAKKLLVPK

SEQ ID NO: 43287 - protein, 8 aa, Artificial Sequence
  Peptide Derived from Human Papillomavirus
NFKEYIRH

SEQ ID NO: 43288 - protein, 11 aa, Artificial Sequence
  Peptide Derived from Human Papillomavirus
PDYLKMTSEPY

SEQ ID NO: 43289 - protein, 9 aa, Artificial Sequence
  Peptide Derived from Human Papillomavirus
PGQPGADNR

SEQ ID NO: 43290 - protein, 10 aa, Artificial Sequence
  Peptide Derived from Human Papillomavirus
PIDICGSTCK

SEQ ID NO: 43291 - protein, 11 aa, Artificial Sequence
  Peptide Derived from Human Papillomavirus
PIDICGSTCKY

SEQ ID NO: 43292 - protein, 9 aa, Artificial Sequence
  Peptide Derived from Human Papillomavirus
PLGVGISGH

SEQ ID NO: 43293 - protein, 9 aa, Artificial Sequence
  Peptide Derived from Human Papillomavirus
PSASLQDTY

SEQ ID NO: 43294 - protein, 10 aa, Artificial Sequence
  Peptide Derived from Human Papillomavirus
PSASLQDTYR

SEQ ID NO: 43295 - protein, 8 aa, Artificial Sequence
  Peptide Derived from Human Papillomavirus
PTGEHWGK

SEQ ID NO: 43296 - protein, 11 aa, Artificial Sequence
  Peptide Derived from Human Papillomavirus
PTNAKKLLVPK

SEQ ID NO: 43297 - protein, 10 aa, Artificial Sequence
  Peptide Derived from Human Papillomavirus
PTSTRTSSAK

SEQ ID NO: 43298 - protein, 11 aa, Artificial Sequence
  Peptide Derived from Human Papillomavirus
PTSTRTSSAKR

SEQ ID NO: 43299 - protein, 11 aa, Artificial Sequence
  Peptide Derived from Human Papillomavirus
PVSKVVSTDEY

SEQ ID NO: 43300 - protein, 9 aa, Artificial Sequence
  Peptide Derived from Human Papillomavirus
QAGLKAKPK

SEQ ID NO: 43301 - protein, 11 aa, Artificial Sequence
  Peptide Derived from Human Papillomavirus
QAGLKAKPKLK

SEQ ID NO: 43302 - protein, 8 aa, Artificial Sequence
  Peptide Derived from Human Papillomavirus
QFVFQLCK

SEQ ID NO: 43303 - protein, 8 aa, Artificial Sequence
  Peptide Derived from Human Papillomavirus
QLCLLGCK

SEQ ID NO: 43304 - protein, 11 aa, Artificial Sequence
  Peptide Derived from Human Papillomavirus
QLFNKPYWLQR

SEQ ID NO: 43305 - protein, 10 aa, Artificial Sequence
  Peptide Derived from Human Papillomavirus
QMFVRHFFNR

SEQ ID NO: 43306 - protein, 10 aa, Artificial Sequence
  Peptide Derived from Human Papillomavirus
QTQLCLLGCK

SEQ ID NO: 43307 - protein, 11 aa, Artificial Sequence
  Peptide Derived from Human Papillomavirus
QVFVTVVDTTR

SEQ ID NO: 43308 - protein, 8 aa, Artificial Sequence
  Peptide Derived from Human Papillomavirus
QVTSDSTY

SEQ ID NO: 43309 - protein, 9 aa, Artificial Sequence
  Peptide Derived from Human Papillomavirus
QVTSDSTYK

SEQ ID NO: 43310 - protein, 8 aa, Artificial Sequence
  Peptide Derived from Human Papillomavirus
RAAPTSTR

SEQ ID NO: 43311 - protein, 9 aa, Artificial Sequence
  Peptide Derived from Human Papillomavirus
RLLAVGHPY

SEQ ID NO: 43312 - protein, 8 aa, Artificial Sequence
  Peptide Derived from Human Papillomavirus
RTSSAKRK

SEQ ID NO: 43313 - protein, 9 aa, Artificial Sequence
  Peptide Derived from Human Papillomavirus
RTSSAKRKK

SEQ ID NO: 43314 - protein, 11 aa, Artificial Sequence
  Peptide Derived from Human Papillomavirus
RTSSAKRKKVK

SEQ ID NO: 43315 - protein, 9 aa, Artificial Sequence
  Peptide Derived from Human Papillomavirus
RVRLPDPNK

SEQ ID NO: 43316 - protein, 11 aa, Artificial Sequence
  Peptide Derived from Human Papillomavirus
SADLDQFPLGR

SEQ ID NO: 43317 - protein, 8 aa, Artificial Sequence
  Peptide Derived from Human Papillomavirus
SAKRKKVK

SEQ ID NO: 43318 - protein, 9 aa, Artificial Sequence
  Peptide Derived from Human Papillomavirus
SAKRKKVKK

SEQ ID NO: 43319 - protein, 8 aa, Artificial Sequence
  Peptide Derived from Human Papillomavirus
SASLQDTY

SEQ ID NO: 43320 - protein, 9 aa, Artificial Sequence
  Peptide Derived from Human Papillomavirus
SASLQDTYR

SEQ ID NO: 43321 - protein, 11 aa, Artificial Sequence
  Peptide Derived from Human Papillomavirus
SDSTYKNENFK

SEQ ID NO: 43322 - protein, 9 aa, Artificial Sequence
  Peptide Derived from Human Papillomavirus
SFYNPDTQR

SEQ ID NO: 43323 - protein, 8 aa, Artificial Sequence
  Peptide Derived from Human Papillomavirus
SGHPLLNK

SEQ ID NO: 43324 - protein, 9 aa, Artificial Sequence
  Peptide Derived from Human Papillomavirus
SGLQYRVFR

SEQ ID NO: 43325 - protein, 11 aa, Artificial Sequence
  Peptide Derived from Human Papillomavirus
SGLQYRVFRVR

SEQ ID NO: 43326 - protein, 9 aa, Artificial Sequence
  Peptide Derived from Human Papillomavirus
SIKNPTNAK

SEQ ID NO: 43327 - protein, 10 aa, Artificial Sequence
  Peptide Derived from Human Papillomavirus
SIKNPTNAKK

SEQ ID NO: 43328 - protein, 10 aa, Artificial Sequence
  Peptide Derived from Human Papillomavirus
SIYYYAGSSR

SEQ ID NO: 43329 - protein, 8 aa, Artificial Sequence
  Peptide Derived from Human Papillomavirus
SLFFFLRR

SEQ ID NO: 43330 - protein, 9 aa, Artificial Sequence
  Peptide Derived from Human Papillomavirus
SSAKRKKVK

SEQ ID NO: 43331 - protein, 10 aa, Artificial Sequence
  Peptide Derived from Human Papillomavirus
SSAKRKKVKK

SEQ ID NO: 43332 - protein, 9 aa, Artificial Sequence
  Peptide Derived from Human Papillomavirus
SSRLLAVGH

SEQ ID NO: 43333 - protein, 11 aa, Artificial Sequence
  Peptide Derived from Human Papillomavirus
SSRLLAVGHPY

SEQ ID NO: 43334 - protein, 8 aa, Artificial Sequence
  Peptide Derived from Human Papillomavirus
STCKYPDY

SEQ ID NO: 43335 - protein, 10 aa, Artificial Sequence
  Peptide Derived from Human Papillomavirus
STCKYPDYLK

SEQ ID NO: 43336 - protein, 8 aa, Artificial Sequence
  Peptide Derived from Human Papillomavirus
STDEYVSR

SEQ ID NO: 43337 - protein, 8 aa, Artificial Sequence
  Peptide Derived from Human Papillomavirus
STRTSSAK

SEQ ID NO: 43338 - protein, 9 aa, Artificial Sequence
  Peptide Derived from Human Papillomavirus
STRTSSAKR

SEQ ID NO: 43339 - protein, 10 aa, Artificial Sequence
  Peptide Derived from Human Papillomavirus
STRTSSAKRK

SEQ ID NO: 43340 - protein, 11 aa, Artificial Sequence
  Peptide Derived from Human Papillomavirus
STRTSSAKRKK

SEQ ID NO: 43341 - protein, 9 aa, Artificial Sequence
  Peptide Derived from Human Papillomavirus
STYKNENFK

SEQ ID NO: 43342 - protein, 11 aa, Artificial Sequence
  Peptide Derived from Human Papillomavirus
STYKNENFKEY

SEQ ID NO: 43343 - protein, 11 aa, Artificial Sequence
  Peptide Derived from Human Papillomavirus
SVWRPSEATVY

SEQ ID NO: 43344 - protein, 9 aa, Artificial Sequence
  Peptide Derived from Human Papillomavirus
TAEVMTYIH

SEQ ID NO: 43345 - protein, 9 aa, Artificial Sequence
  Peptide Derived from Human Papillomavirus
TCKYPDYLK

SEQ ID NO: 43346 - protein, 9 aa, Artificial Sequence
  Peptide Derived from Human Papillomavirus
TCQKTVPPK

SEQ ID NO: 43347 - protein, 11 aa, Artificial Sequence
  Peptide Derived from Human Papillomavirus
TCQKTVPPKEK

SEQ ID NO: 43348 - protein, 11 aa, Artificial Sequence
  Peptide Derived from Human Papillomavirus
TDEYVSRTSIY

SEQ ID NO: 43349 - protein, 8 aa, Artificial Sequence
  Peptide Derived from Human Papillomavirus
TFWEVDLK

SEQ ID NO: 43350 - protein, 10 aa, Artificial Sequence
  Peptide Derived from Human Papillomavirus
TFWEVDLKEK

SEQ ID NO: 43351 - protein, 9 aa, Artificial Sequence
  Peptide Derived from Human Papillomavirus
TGFGCMDFK

SEQ ID NO: 43352 - protein, 11 aa, Artificial Sequence
  Peptide Derived from Human Papillomavirus
TLGEAVPDDLY

SEQ ID NO: 43353 - protein, 9 aa, Artificial Sequence
  Peptide Derived from Human Papillomavirus
TLTAEVMTY

SEQ ID NO: 43354 - protein, 11 aa, Artificial Sequence
  Peptide Derived from Human Papillomavirus
TLTAEVMTYIH

SEQ ID NO: 43355 - protein, 10 aa, Artificial Sequence
  Peptide Derived from Human Papillomavirus
TNAKKLLVPK

SEQ ID NO: 43356 - protein, 9 aa, Artificial Sequence
  Peptide Derived from Human Papillomavirus
TSESQLFNK

SEQ ID NO: 43357 - protein, 11 aa, Artificial Sequence
  Peptide Derived from Human Papillomavirus
TSESQLFNKPY

SEQ ID NO: 43358 - protein, 10 aa, Artificial Sequence
  Peptide Derived from Human Papillomavirus
TSFYNPDTQR

SEQ ID NO: 43359 - protein, 11 aa, Artificial Sequence
  Peptide Derived from Human Papillomavirus
TSIYYYAGSSR

SEQ ID NO: 43360 - protein, 9 aa, Artificial Sequence
  Peptide Derived from Human Papillomavirus
TSQAITCQK

SEQ ID NO: 43361 - protein, 8 aa, Artificial Sequence
  Peptide Derived from Human Papillomavirus
TSSAKRKK

SEQ ID NO: 43362 - protein, 10 aa, Artificial Sequence
  Peptide Derived from Human Papillomavirus
TSSAKRKKVK

SEQ ID NO: 43363 - protein, 11 aa, Artificial Sequence
  Peptide Derived from Human Papillomavirus
TSSAKRKKVKK

SEQ ID NO: 43364 - protein, 9 aa, Artificial Sequence
  Peptide Derived from Human Papillomavirus
TSTRTSSAK

SEQ ID NO: 43365 - protein, 10 aa, Artificial Sequence
  Peptide Derived from Human Papillomavirus
TSTRTSSAKR

SEQ ID NO: 43366 - protein, 11 aa, Artificial Sequence
  Peptide Derived from Human Papillomavirus
TSTRTSSAKRK

SEQ ID NO: 43367 - protein, 11 aa, Artificial Sequence
  Peptide Derived from Human Papillomavirus
TVYLPPVPVSK

SEQ ID NO: 43368 - protein, 11 aa, Artificial Sequence
  Peptide Derived from Human Papillomavirus
VDTGFGCMDFK

SEQ ID NO: 43369 - protein, 11 aa, Artificial Sequence
  Peptide Derived from Human Papillomavirus
VFRVRLPDPNK

SEQ ID NO: 43370 - protein, 10 aa, Artificial Sequence
  Peptide Derived from Human Papillomavirus
VFVTVVDTTR

SEQ ID NO: 43371 - protein, 9 aa, Artificial Sequence
  Peptide Derived from Human Papillomavirus
VGHPYFSIK

SEQ ID NO: 43372 - protein, 11 aa, Artificial Sequence
  Peptide Derived from Human Papillomavirus
VGISGHPLLNK

SEQ ID NO: 43373 - protein, 10 aa, Artificial Sequence
  Peptide Derived from Human Papillomavirus
VSGLQYRVFR

SEQ ID NO: 43374 - protein, 10 aa, Artificial Sequence
  Peptide Derived from Human Papillomavirus
VSKVVSTDEY

SEQ ID NO: 43375 - protein, 8 aa, Artificial Sequence
  Peptide Derived from Human Papillomavirus
VSRTSIYY

SEQ ID NO: 43376 - protein, 9 aa, Artificial Sequence
  Peptide Derived from Human Papillomavirus
VSRTSIYYY

SEQ ID NO: 43377 - protein, 9 aa, Artificial Sequence
  Peptide Derived from Human Papillomavirus
VSTDEYVSR

SEQ ID NO: 43378 - protein, 10 aa, Artificial Sequence
  Peptide Derived from Human Papillomavirus
VTLTAEVMTY

SEQ ID NO: 43379 - protein, 8 aa, Artificial Sequence
  Peptide Derived from Human Papillomavirus
VTSDSTYK

SEQ ID NO: 43380 - protein, 10 aa, Artificial Sequence
  Peptide Derived from Human Papillomavirus
VTSESQLFNK

SEQ ID NO: 43381 - protein, 10 aa, Artificial Sequence
  Peptide Derived from Human Papillomavirus
VTSQAITCQK

SEQ ID NO: 43382 - protein, 8 aa, Artificial Sequence
  Peptide Derived from Human Papillomavirus
VTVVDTTR

SEQ ID NO: 43383 - protein, 10 aa, Artificial Sequence
  Peptide Derived from Human Papillomavirus
VVSTDEYVSR

SEQ ID NO: 43384 - protein, 10 aa, Artificial Sequence
  Peptide Derived from Human Papillomavirus
WACVGLEIGR

SEQ ID NO: 43385 - protein, 8 aa, Artificial Sequence
  Peptide Derived from Human Papillomavirus
WLQRAQGH

SEQ ID NO: 43386 - protein, 11 aa, Artificial Sequence
  Peptide Derived from Human Papillomavirus
YDLQFVFQLCK

SEQ ID NO: 43387 - protein, 11 aa, Artificial Sequence
  Peptide Derived from Human Papillomavirus
YFSIKNPTNAK

SEQ ID NO: 43388 - protein, 10 aa, Artificial Sequence
  Peptide Derived from Human Papillomavirus
YGDSLFFFLR

SEQ ID NO: 43389 - protein, 11 aa, Artificial Sequence
  Peptide Derived from Human Papillomavirus
YGDSLFFFLRR

SEQ ID NO: 43390 - protein, 8 aa, Artificial Sequence
  Peptide Derived from Human Papillomavirus
YIRHVEEY

SEQ ID NO: 43391 - protein, 9 aa, Artificial Sequence
  Peptide Derived from Human Papillomavirus
YLKMTSEPY

SEQ ID NO: 43392 - protein, 9 aa, Artificial Sequence
  Peptide Derived from Human Papillomavirus
YLPPVPVSK

SEQ ID NO: 43393 - protein, 9 aa, Artificial Sequence
  Peptide Derived from Human Papillomavirus
YTFWEVDLK

SEQ ID NO: 43394 - protein, 11 aa, Artificial Sequence
  Peptide Derived from Human Papillomavirus
YTFWEVDLKEK

SEQ ID NO: 43395 - protein, 8 aa, Artificial Sequence
  Peptide Derived from Human Papillomavirus
YVSRTSIY

SEQ ID NO: 43396 - protein, 9 aa, Artificial Sequence
  Peptide Derived from Human Papillomavirus
YVSRTSIYY

SEQ ID NO: 43397 - protein, 10 aa, Artificial Sequence
  Peptide Derived from Human Papillomavirus
YVSRTSIYYY

SEQ ID NO: 43398 - protein, 9 aa, Artificial Sequence
  Peptide Derived from Human Papillomavirus
AAIPLQPIR

SEQ ID NO: 43399 - protein, 8 aa, Artificial Sequence
  Peptide Derived from Human Papillomavirus
ADDVDNVH

SEQ ID NO: 43400 - protein, 9 aa, Artificial Sequence
  Peptide Derived from Human Papillomavirus
ADFVLHPSY

SEQ ID NO: 43401 - protein, 8 aa, Artificial Sequence
  Peptide Derived from Human Papillomavirus
AFLTSPHK

SEQ ID NO: 43402 - protein, 8 aa, Artificial Sequence
  Peptide Derived from Human Papillomavirus
AIPLQPIR

SEQ ID NO: 43403 - protein, 10 aa, Artificial Sequence
  Peptide Derived from Human Papillomavirus
AITSRRHTVR

SEQ ID NO: 43404 - protein, 10 aa, Artificial Sequence
  Peptide Derived from Human Papillomavirus
ALHRPAITSR

SEQ ID NO: 43405 - protein, 11 aa, Artificial Sequence
  Peptide Derived from Human Papillomavirus
ALHRPAITSRR

SEQ ID NO: 43406 - protein, 11 aa, Artificial Sequence
  Peptide Derived from Human Papillomavirus
ASATQLYQTCK

SEQ ID NO: 43407 - protein, 9 aa, Artificial Sequence
  Peptide Derived from Human Papillomavirus
ATLKTRSGK

SEQ ID NO: 43408 - protein, 9 aa, Artificial Sequence
  Peptide Derived from Human Papillomavirus
ATQLYQTCK

SEQ ID NO: 43409 - protein, 9 aa, Artificial Sequence
  Peptide Derived from Human Papillomavirus
DFLDIIALH

SEQ ID NO: 43410 - protein, 10 aa, Artificial Sequence
  Peptide Derived from Human Papillomavirus
DFLDIIALHR

SEQ ID NO: 43411 - protein, 8 aa, Artificial Sequence
  Peptide Derived from Human Papillomavirus
DFVLHPSY

SEQ ID NO: 43412 - protein, 8 aa, Artificial Sequence
  Peptide Derived from Human Papillomavirus
DGADFVLH

SEQ ID NO: 43413 - protein, 11 aa, Artificial Sequence
  Peptide Derived from Human Papillomavirus
DGADFVLHPSY

SEQ ID NO: 43414 - protein, 10 aa, Artificial Sequence
  Peptide Derived from Human Papillomavirus
DLSPIVPLDH

SEQ ID NO: 43415 - protein, 9 aa, Artificial Sequence
  Peptide Derived from Human Papillomavirus
DNVHTPMQH

SEQ ID NO: 43416 - protein, 11 aa, Artificial Sequence
  Peptide Derived from Human Papillomavirus
DNVHTPMQHSY

SEQ ID NO: 43417 - protein, 11 aa, Artificial Sequence
  Peptide Derived from Human Papillomavirus
DVDNVHTPMQH

SEQ ID NO: 43418 - protein, 11 aa, Artificial Sequence
  Peptide Derived from Human Papillomavirus
DVYADDVDNVH

SEQ ID NO: 43419 - protein, 8 aa, Artificial Sequence
  Peptide Derived from Human Papillomavirus
EDTLQFQH

SEQ ID NO: 43420 - protein, 11 aa, Artificial Sequence
  Peptide Derived from Human Papillomavirus
EGSTIADQILK

SEQ ID NO: 43421 - protein, 10 aa, Artificial Sequence
  Peptide Derived from Human Papillomavirus
ESSIQTISTH

SEQ ID NO: 43422 - protein, 11 aa, Artificial Sequence
  Peptide Derived from Human Papillomavirus
FDPEDTLQFQH

SEQ ID NO: 43423 - protein, 8 aa, Artificial Sequence
  Peptide Derived from Human Papillomavirus
FILRRRRK

SEQ ID NO: 43424 - protein, 9 aa, Artificial Sequence
  Peptide Derived from Human Papillomavirus
FILRRRRKR

SEQ ID NO: 43425 - protein, 8 aa, Artificial Sequence
  Peptide Derived from Human Papillomavirus
FLDIIALH

SEQ ID NO: 43426 - protein, 9 aa, Artificial Sequence
  Peptide Derived from Human Papillomavirus
FLDIIALHR

SEQ ID NO: 43427 - protein, 11 aa, Artificial Sequence
  Peptide Derived from Human Papillomavirus
FLTSPHKLITY

SEQ ID NO: 43428 - protein, 11 aa, Artificial Sequence
  Peptide Derived from Human Papillomavirus
FSRVGQKATLK

SEQ ID NO: 43429 - protein, 11 aa, Artificial Sequence
  Peptide Derived from Human Papillomavirus
FSSPTVSTQSY

SEQ ID NO: 43430 - protein, 8 aa, Artificial Sequence
  Peptide Derived from Human Papillomavirus
FTEPSVLH

SEQ ID NO: 43431 - protein, 11 aa, Artificial Sequence
  Peptide Derived from Human Papillomavirus
FVLHPSYFILR

SEQ ID NO: 43432 - protein, 10 aa, Artificial Sequence
  Peptide Derived from Human Papillomavirus
GADFVLHPSY

SEQ ID NO: 43433 - protein, 11 aa, Artificial Sequence
  Peptide Derived from Human Papillomavirus
GIGTGSGSGGR

SEQ ID NO: 43434 - protein, 11 aa, Artificial Sequence
  Peptide Derived from Human Papillomavirus
GLYSRNTQQVK

SEQ ID NO: 43435 - protein, 8 aa, Artificial Sequence
  Peptide Derived from Human Papillomavirus
GSGGRTGY

SEQ ID NO: 43436 - protein, 10 aa, Artificial Sequence
  Peptide Derived from Human Papillomavirus
GSGSGGRTGY

SEQ ID NO: 43437 - protein, 11 aa, Artificial Sequence
  Peptide Derived from Human Papillomavirus
GSRPVARLGLY

SEQ ID NO: 43438 - protein, 10 aa, Artificial Sequence
  Peptide Derived from Human Papillomavirus
GSTIADQILK

SEQ ID NO: 43439 - protein, 11 aa, Artificial Sequence
  Peptide Derived from Human Papillomavirus
GSTIADQILKY

SEQ ID NO: 43440 - protein, 10 aa, Artificial Sequence
  Peptide Derived from Human Papillomavirus
GTCPPDVIPK

SEQ ID NO: 43441 - protein, 9 aa, Artificial Sequence
  Peptide Derived from Human Papillomavirus
GTGSGSGGR

SEQ ID NO: 43442 - protein, 8 aa, Artificial Sequence
  Peptide Derived from Human Papillomavirus
HDTSTSSY

SEQ ID NO: 43443 - protein, 10 aa, Artificial Sequence
  Peptide Derived from Human Papillomavirus
HSYSTFATTR

SEQ ID NO: 43444 - protein, 8 aa, Artificial Sequence
  Peptide Derived from Human Papillomavirus
HTPMQHSY

SEQ ID NO: 43445 - protein, 8 aa, Artificial Sequence
  Peptide Derived from Human Papillomavirus
HTVPNEQY

SEQ ID NO: 43446 - protein, 11 aa, Artificial Sequence
  Peptide Derived from Human Papillomavirus
HTVRFSRVGQK

SEQ ID NO: 43447 - protein, 8 aa, Artificial Sequence
  Peptide Derived from Human Papillomavirus
IADQILKY

SEQ ID NO: 43448 - protein, 11 aa, Artificial Sequence
  Peptide Derived from Human Papillomavirus
IALHRPAITSR

SEQ ID NO: 43449 - protein, 8 aa, Artificial Sequence
  Peptide Derived from Human Papillomavirus
IGARIHYY

SEQ ID NO: 43450 - protein, 10 aa, Artificial Sequence
  Peptide Derived from Human Papillomavirus
IGTGSGSGGR

SEQ ID NO: 43451 - protein, 8 aa, Artificial Sequence
  Peptide Derived from Human Papillomavirus
ILRRRRKR

SEQ ID NO: 43452 - protein, 11 aa, Artificial Sequence
  Peptide Derived from Human Papillomavirus
ILRRRRKRFPY

SEQ ID NO: 43453 - protein, 9 aa, Artificial Sequence
  Peptide Derived from Human Papillomavirus
INDGLYDVY

SEQ ID NO: 43454 - protein, 9 aa, Artificial Sequence
  Peptide Derived from Human Papillomavirus
ITSRRHTVR

SEQ ID NO: 43455 - protein, 11 aa, Artificial Sequence
  Peptide Derived from Human Papillomavirus
IVVDGADFVLH

SEQ ID NO: 43456 - protein, 10 aa, Artificial Sequence
  Peptide Derived from Human Papillomavirus
KATLKTRSGK

SEQ ID NO: 43457 - protein, 11 aa, Artificial Sequence
  Peptide Derived from Human Papillomavirus
KTRSGKQIGAR

SEQ ID NO: 43458 - protein, 10 aa, Artificial Sequence
  Peptide Derived from Human Papillomavirus
LDHTVPNEQY

SEQ ID NO: 43459 - protein, 8 aa, Artificial Sequence
  Peptide Derived from Human Papillomavirus
LDIIALHR

SEQ ID NO: 43460 - protein, 9 aa, Artificial Sequence
  Peptide Derived from Human Papillomavirus
LSPIVPLDH

SEQ ID NO: 43461 - protein, 10 aa, Artificial Sequence
  Peptide Derived from Human Papillomavirus
LTSPHKLITY

SEQ ID NO: 43462 - protein, 8 aa, Artificial Sequence
  Peptide Derived from Human Papillomavirus
NDGLYDVY

SEQ ID NO: 43463 - protein, 8 aa, Artificial Sequence
  Peptide Derived from Human Papillomavirus
NVHTPMQH

SEQ ID NO: 43464 - protein, 10 aa, Artificial Sequence
  Peptide Derived from Human Papillomavirus
NVHTPMQHSY

SEQ ID NO: 43465 - protein, 8 aa, Artificial Sequence
  Peptide Derived from Human Papillomavirus
PAFLTSPH

SEQ ID NO: 43466 - protein, 9 aa, Artificial Sequence
  Peptide Derived from Human Papillomavirus
PAFLTSPHK

SEQ ID NO: 43467 - protein, 8 aa, Artificial Sequence
  Peptide Derived from Human Papillomavirus
PAITSRRH

SEQ ID NO: 43468 - protein, 11 aa, Artificial Sequence
  Peptide Derived from Human Papillomavirus
PAITSRRHTVR

SEQ ID NO: 43469 - protein, 9 aa, Artificial Sequence
  Peptide Derived from Human Papillomavirus
PAPAEASGH

SEQ ID NO: 43470 - protein, 10 aa, Artificial Sequence
  Peptide Derived from Human Papillomavirus
PDFLDIIALH

SEQ ID NO: 43471 - protein, 11 aa, Artificial Sequence
  Peptide Derived from Human Papillomavirus
PDFLDIIALHR

SEQ ID NO: 43472 - protein, 8 aa, Artificial Sequence
  Peptide Derived from Human Papillomavirus
PGSRPVAR

SEQ ID NO: 43473 - protein, 10 aa, Artificial Sequence
  Peptide Derived from Human Papillomavirus
PIPGSRPVAR

SEQ ID NO: 43474 - protein, 11 aa, Artificial Sequence
  Peptide Derived from Human Papillomavirus
PLDHTVPNEQY

SEQ ID NO: 43475 - protein, 10 aa, Artificial Sequence
  Peptide Derived from Human Papillomavirus
PLHDTSTSSY

SEQ ID NO: 43476 - protein, 11 aa, Artificial Sequence
  Peptide Derived from Human Papillomavirus
PNEQYELQPLH

SEQ ID NO: 43477 - protein, 8 aa, Artificial Sequence
  Peptide Derived from Human Papillomavirus
PSYFILRR

SEQ ID NO: 43478 - protein, 9 aa, Artificial Sequence
  Peptide Derived from Human Papillomavirus
PSYFILRRR

SEQ ID NO: 43479 - protein, 10 aa, Artificial Sequence
  Peptide Derived from Human Papillomavirus
PSYFILRRRR

SEQ ID NO: 43480 - protein, 11 aa, Artificial Sequence
  Peptide Derived from Human Papillomavirus
PSYFILRRRRK

SEQ ID NO: 43481 - protein, 11 aa, Artificial Sequence
  Peptide Derived from Human Papillomavirus
PTAAIPLQPIR

SEQ ID NO: 43482 - protein, 10 aa, Artificial Sequence
  Peptide Derived from Human Papillomavirus
PTFTEPSVLH

SEQ ID NO: 43483 - protein, 8 aa, Artificial Sequence
  Peptide Derived from Human Papillomavirus
PTVSTQSY

SEQ ID NO: 43484 - protein, 8 aa, Artificial Sequence
  Peptide Derived from Human Papillomavirus
PVARLGLY

SEQ ID NO: 43485 - protein, 10 aa, Artificial Sequence
  Peptide Derived from Human Papillomavirus
PVARLGLYSR

SEQ ID NO: 43486 - protein, 11 aa, Artificial Sequence
  Peptide Derived from Human Papillomavirus
QDLSPIVPLDH

SEQ ID NO: 43487 - protein, 8 aa, Artificial Sequence
  Peptide Derived from Human Papillomavirus
QIGARIHY

SEQ ID NO: 43488 - protein, 9 aa, Artificial Sequence
  Peptide Derived from Human Papillomavirus
QIGARIHYY

SEQ ID NO: 43489 - protein, 8 aa, Artificial Sequence
  Peptide Derived from Human Papillomavirus
RASATQLY

SEQ ID NO: 43490 - protein, 10 aa, Artificial Sequence
  Peptide Derived from Human Papillomavirus
RFPYFFTDVR

SEQ ID NO: 43491 - protein, 8 aa, Artificial Sequence
  Peptide Derived from Human Papillomavirus
RFSRVGQK

SEQ ID NO: 43492 - protein, 9 aa, Artificial Sequence
  Peptide Derived from Human Papillomavirus
RSGKQIGAR

SEQ ID NO: 43493 - protein, 11 aa, Artificial Sequence
  Peptide Derived from Human Papillomavirus
RSGKQIGARIH

SEQ ID NO: 43494 - protein, 9 aa, Artificial Sequence
  Peptide Derived from Human Papillomavirus
RVGQKATLK

SEQ ID NO: 43495 - protein, 11 aa, Artificial Sequence
  Peptide Derived from Human Papillomavirus
RVGQKATLKTR

SEQ ID NO: 43496 - protein, 10 aa, Artificial Sequence
  Peptide Derived from Human Papillomavirus
SATQLYQTCK

SEQ ID NO: 43497 - protein, 8 aa, Artificial Sequence
  Peptide Derived from Human Papillomavirus
SGKQIGAR

SEQ ID NO: 43498 - protein, 10 aa, Artificial Sequence
  Peptide Derived from Human Papillomavirus
SGKQIGARIH

SEQ ID NO: 43499 - protein, 11 aa, Artificial Sequence
  Peptide Derived from Human Papillomavirus
SGKQIGARIHY

SEQ ID NO: 43500 - protein, 9 aa, Artificial Sequence
  Peptide Derived from Human Papillomavirus
SGSGGRTGY

SEQ ID NO: 43501 - protein, 10 aa, Artificial Sequence
  Peptide Derived from Human Papillomavirus
SINDGLYDVY

SEQ ID NO: 43502 - protein, 8 aa, Artificial Sequence
  Peptide Derived from Human Papillomavirus
SIQTISTH

SEQ ID NO: 43503 - protein, 9 aa, Artificial Sequence
  Peptide Derived from Human Papillomavirus
SSIQTISTH

SEQ ID NO: 43504 - protein, 10 aa, Artificial Sequence
  Peptide Derived from Human Papillomavirus
SSPTVSTQSY

SEQ ID NO: 43505 - protein, 9 aa, Artificial Sequence
  Peptide Derived from Human Papillomavirus
SSTPIPGSR

SEQ ID NO: 43506 - protein, 10 aa, Artificial Sequence
  Peptide Derived from Human Papillomavirus
SSYSINDGLY

SEQ ID NO: 43507 - protein, 9 aa, Artificial Sequence
  Peptide Derived from Human Papillomavirus
STIADQILK

SEQ ID NO: 43508 - protein, 10 aa, Artificial Sequence
  Peptide Derived from Human Papillomavirus
STIADQILKY

SEQ ID NO: 43509 - protein, 8 aa, Artificial Sequence
  Peptide Derived from Human Papillomavirus
STPIPGSR

SEQ ID NO: 43510 - protein, 10 aa, Artificial Sequence
  Peptide Derived from Human Papillomavirus
TAAIPLQPIR

SEQ ID NO: 43511 - protein, 9 aa, Artificial Sequence
  Peptide Derived from Human Papillomavirus
TCPPDVIPK

SEQ ID NO: 43512 - protein, 9 aa, Artificial Sequence
  Peptide Derived from Human Papillomavirus
TFTEPSVLH

SEQ ID NO: 43513 - protein, 8 aa, Artificial Sequence
  Peptide Derived from Human Papillomavirus
TGSGSGGR

SEQ ID NO: 43514 - protein, 11 aa, Artificial Sequence
  Peptide Derived from Human Papillomavirus
TGSGSGGRTGY

SEQ ID NO: 43515 - protein, 11 aa, Artificial Sequence
  Peptide Derived from Human Papillomavirus
TGTCPPDVIPK

SEQ ID NO: 43516 - protein, 8 aa, Artificial Sequence
  Peptide Derived from Human Papillomavirus
TIADQILK

SEQ ID NO: 43517 - protein, 9 aa, Artificial Sequence
  Peptide Derived from Human Papillomavirus
TIADQILKY

SEQ ID NO: 43518 - protein, 8 aa, Artificial Sequence
  Peptide Derived from Human Papillomavirus
TLKTRSGK

SEQ ID NO: 43519 - protein, 9 aa, Artificial Sequence
  Peptide Derived from Human Papillomavirus
TSPHKLITY

SEQ ID NO: 43520 - protein, 8 aa, Artificial Sequence
  Peptide Derived from Human Papillomavirus
TSRRHTVR

SEQ ID NO: 43521 - protein, 11 aa, Artificial Sequence
  Peptide Derived from Human Papillomavirus
TSRRHTVRFSR

SEQ ID NO: 43522 - protein, 10 aa, Artificial Sequence
  Peptide Derived from Human Papillomavirus
TSSTPIPGSR

SEQ ID NO: 43523 - protein, 11 aa, Artificial Sequence
  Peptide Derived from Human Papillomavirus
TSSYSINDGLY

SEQ ID NO: 43524 - protein, 10 aa, Artificial Sequence
  Peptide Derived from Human Papillomavirus
TVRFSRVGQK

SEQ ID NO: 43525 - protein, 9 aa, Artificial Sequence
  Peptide Derived from Human Papillomavirus
VARLGLYSR

SEQ ID NO: 43526 - protein, 9 aa, Artificial Sequence
  Peptide Derived from Human Papillomavirus
VDGADFVLH

SEQ ID NO: 43527 - protein, 10 aa, Artificial Sequence
  Peptide Derived from Human Papillomavirus
VDNVHTPMQH

SEQ ID NO: 43528 - protein, 10 aa, Artificial Sequence
  Peptide Derived from Human Papillomavirus
VDPAFLTSPH

SEQ ID NO: 43529 - protein, 11 aa, Artificial Sequence
  Peptide Derived from Human Papillomavirus
VDPAFLTSPHK

SEQ ID NO: 43530 - protein, 8 aa, Artificial Sequence
  Peptide Derived from Human Papillomavirus
VGQKATLK

SEQ ID NO: 43531 - protein, 10 aa, Artificial Sequence
  Peptide Derived from Human Papillomavirus
VGQKATLKTR

SEQ ID NO: 43532 - protein, 10 aa, Artificial Sequence
  Peptide Derived from Human Papillomavirus
VLHPSYFILR

SEQ ID NO: 43533 - protein, 11 aa, Artificial Sequence
  Peptide Derived from Human Papillomavirus
VLHPSYFILRR

SEQ ID NO: 43534 - protein, 11 aa, Artificial Sequence
  Peptide Derived from Human Papillomavirus
VTSSTPIPGSR

SEQ ID NO: 43535 - protein, 10 aa, Artificial Sequence
  Peptide Derived from Human Papillomavirus
VVDGADFVLH

SEQ ID NO: 43536 - protein, 11 aa, Artificial Sequence
  Peptide Derived from Human Papillomavirus
VVDPAFLTSPH

SEQ ID NO: 43537 - protein, 9 aa, Artificial Sequence
  Peptide Derived from Human Papillomavirus
YADDVDNVH

SEQ ID NO: 43538 - protein, 8 aa, Artificial Sequence
  Peptide Derived from Human Papillomavirus
YFILRRRR

SEQ ID NO: 43539 - protein, 9 aa, Artificial Sequence
  Peptide Derived from Human Papillomavirus
YFILRRRRK

SEQ ID NO: 43540 - protein, 10 aa, Artificial Sequence
  Peptide Derived from Human Papillomavirus
YFILRRRRKR

SEQ ID NO: 43541 - protein, 8 aa, Artificial Sequence
  Peptide Derived from Human Papillomavirus
YSINDGLY

SEQ ID NO: 43542 - protein, 11 aa, Artificial Sequence
  Peptide Derived from Human Papillomavirus
YSINDGLYDVY

SEQ ID NO: 43543 - protein, 9 aa, Artificial Sequence
  Peptide Derived from Human Papillomavirus
YSRNTQQVK

SEQ ID NO: 43544 - protein, 8 aa, Artificial Sequence
  Peptide Derived from Human Papillomavirus
YSTFATTR

SEQ ID NO: 43545 - protein, 11 aa, Artificial Sequence
  Peptide Derived from Human Papillomavirus
AAFLKSNCQAK

SEQ ID NO: 43546 - protein, 8 aa, Artificial Sequence
  Peptide Derived from Human Papillomavirus
AAMLAVFK

SEQ ID NO: 43547 - protein, 11 aa, Artificial Sequence
  Peptide Derived from Human Papillomavirus
AAMLAVFKDIY

SEQ ID NO: 43548 - protein, 10 aa, Artificial Sequence
  Peptide Derived from Human Papillomavirus
AFLKSNCQAK

SEQ ID NO: 43549 - protein, 11 aa, Artificial Sequence
  Peptide Derived from Human Papillomavirus
AFLKSNCQAKY

SEQ ID NO: 43550 - protein, 11 aa, Artificial Sequence
  Peptide Derived from Human Papillomavirus
AIISFVNSNSH

SEQ ID NO: 43551 - protein, 11 aa, Artificial Sequence
  Peptide Derived from Human Papillomavirus
ALDGNPISIDR

SEQ ID NO: 43552 - protein, 11 aa, Artificial Sequence
  Peptide Derived from Human Papillomavirus
ALKEFLKGTPK

SEQ ID NO: 43553 - protein, 9 aa, Artificial Sequence
  Peptide Derived from Human Papillomavirus
ALLRYKCGK

SEQ ID NO: 43554 - protein, 11 aa, Artificial Sequence
  Peptide Derived from Human Papillomavirus
ALLRYKCGKNR

SEQ ID NO: 43555 - protein, 10 aa, Artificial Sequence
  Peptide Derived from Human Papillomavirus
AMLAVFKDIY

SEQ ID NO: 43556 - protein, 8 aa, Artificial Sequence
  Peptide Derived from Human Papillomavirus
AMLDDATH

SEQ ID NO: 43557 - protein, 8 aa, Artificial Sequence
  Peptide Derived from Human Papillomavirus
ATHTCWTY

SEQ ID NO: 43558 - protein, 8 aa, Artificial Sequence
  Peptide Derived from Human Papillomavirus
AVMCRHYK

SEQ ID NO: 43559 - protein, 9 aa, Artificial Sequence
  Peptide Derived from Human Papillomavirus
AVMCRHYKR

SEQ ID NO: 43560 - protein, 8 aa, Artificial Sequence
  Peptide Derived from Human Papillomavirus
CAVMCRHY

SEQ ID NO: 43561 - protein, 9 aa, Artificial Sequence
  Peptide Derived from Human Papillomavirus
CAVMCRHYK

SEQ ID NO: 43562 - protein, 10 aa, Artificial Sequence
  Peptide Derived from Human Papillomavirus
CAVMCRHYKR

SEQ ID NO: 43563 - protein, 9 aa, Artificial Sequence
  Peptide Derived from Human Papillomavirus
CFFERTWSR

SEQ ID NO: 43564 - protein, 10 aa, Artificial Sequence
  Peptide Derived from Human Papillomavirus
CGKNRLTVAK

SEQ ID NO: 43565 - protein, 8 aa, Artificial Sequence
  Peptide Derived from Human Papillomavirus
CMLIEPPK

SEQ ID NO: 43566 - protein, 10 aa, Artificial Sequence
  Peptide Derived from Human Papillomavirus
CMLIEPPKLR

SEQ ID NO: 43567 - protein, 10 aa, Artificial Sequence
  Peptide Derived from Human Papillomavirus
CNSNAAAFLK

SEQ ID NO: 43568 - protein, 11 aa, Artificial Sequence
  Peptide Derived from Human Papillomavirus
CSKIDEGGDWR

SEQ ID NO: 43569 - protein, 8 aa, Artificial Sequence
  Peptide Derived from Human Papillomavirus
CVTGQNTR

SEQ ID NO: 43570 - protein, 9 aa, Artificial Sequence
  Peptide Derived from Human Papillomavirus
DAQVLHLLK

SEQ ID NO: 43571 - protein, 10 aa, Artificial Sequence
  Peptide Derived from Human Papillomavirus
DAQVLHLLKR

SEQ ID NO: 43572 - protein, 11 aa, Artificial Sequence
  Peptide Derived from Human Papillomavirus
DAQVLHLLKRK

SEQ ID NO: 43573 - protein, 9 aa, Artificial Sequence
  Peptide Derived from Human Papillomavirus
DATHTCWTY

SEQ ID NO: 43574 - protein, 8 aa, Artificial Sequence
  Peptide Derived from Human Papillomavirus
DCAVMCRH

SEQ ID NO: 43575 - protein, 9 aa, Artificial Sequence
  Peptide Derived from Human Papillomavirus
DCAVMCRHY

SEQ ID NO: 43576 - protein, 10 aa, Artificial Sequence
  Peptide Derived from Human Papillomavirus
DCAVMCRHYK

SEQ ID NO: 43577 - protein, 11 aa, Artificial Sequence
  Peptide Derived from Human Papillomavirus
DCAVMCRHYKR

SEQ ID NO: 43578 - protein, 11 aa, Artificial Sequence
  Peptide Derived from Human Papillomavirus
DCNSNAAAFLK

SEQ ID NO: 43579 - protein, 10 aa, Artificial Sequence
  Peptide Derived from Human Papillomavirus
DDATHTCWTY

SEQ ID NO: 43580 - protein, 9 aa, Artificial Sequence
  Peptide Derived from Human Papillomavirus
DGNPISIDR

SEQ ID NO: 43581 - protein, 10 aa, Artificial Sequence
  Peptide Derived from Human Papillomavirus
DGNPISIDRK

SEQ ID NO: 43582 - protein, 11 aa, Artificial Sequence
  Peptide Derived from Human Papillomavirus
DGNPISIDRKH

SEQ ID NO: 43583 - protein, 10 aa, Artificial Sequence
  Peptide Derived from Human Papillomavirus
DLVRNFKSDK

SEQ ID NO: 43584 - protein, 9 aa, Artificial Sequence
  Peptide Derived from Human Papillomavirus
DNAENVDPH

SEQ ID NO: 43585 - protein, 10 aa, Artificial Sequence
  Peptide Derived from Human Papillomavirus
DNKWPYLESR

SEQ ID NO: 43586 - protein, 11 aa, Artificial Sequence
  Peptide Derived from Human Papillomavirus
DTEGIPFGTFK

SEQ ID NO: 43587 - protein, 8 aa, Artificial Sequence
  Peptide Derived from Human Papillomavirus
DTPEWIQR

SEQ ID NO: 43588 - protein, 10 aa, Artificial Sequence
  Peptide Derived from Human Papillomavirus
EFISFLRALK

SEQ ID NO: 43589 - protein, 8 aa, Artificial Sequence
  Peptide Derived from Human Papillomavirus
EFLKGTPK

SEQ ID NO: 43590 - protein, 9 aa, Artificial Sequence
  Peptide Derived from Human Papillomavirus
EFLKGTPKK

SEQ ID NO: 43591 - protein, 8 aa, Artificial Sequence
  Peptide Derived from Human Papillomavirus
EGFKTLIK

SEQ ID NO: 43592 - protein, 9 aa, Artificial Sequence
  Peptide Derived from Human Papillomavirus
EGIPFGTFK

SEQ ID NO: 43593 - protein, 8 aa, Artificial Sequence
  Peptide Derived from Human Papillomavirus
EINDKNWK

SEQ ID NO: 43594 - protein, 8 aa, Artificial Sequence
  Peptide Derived from Human Papillomavirus
EISLNSGH

SEQ ID NO: 43595 - protein, 9 aa, Artificial Sequence
  Peptide Derived from Human Papillomavirus
EISLNSGHK

SEQ ID NO: 43596 - protein, 10 aa, Artificial Sequence
  Peptide Derived from Human Papillomavirus
EISLNSGHKK

SEQ ID NO: 43597 - protein, 11 aa, Artificial Sequence
  Peptide Derived from Human Papillomavirus
ELKELLQASNK

SEQ ID NO: 43598 - protein, 8 aa, Artificial Sequence
  Peptide Derived from Human Papillomavirus
ELLQASNK

SEQ ID NO: 43599 - protein, 9 aa, Artificial Sequence
  Peptide Derived from Human Papillomavirus
ELLQASNKK

SEQ ID NO: 43600 - protein, 8 aa, Artificial Sequence
  Peptide Derived from Human Papillomavirus
ESDMAFQY

SEQ ID NO: 43601 - protein, 11 aa, Artificial Sequence
  Peptide Derived from Human Papillomavirus
ESRVTVFTFPH

SEQ ID NO: 43602 - protein, 8 aa, Artificial Sequence
  Peptide Derived from Human Papillomavirus
ETAQALFH

SEQ ID NO: 43603 - protein, 10 aa, Artificial Sequence
  Peptide Derived from Human Papillomavirus
ETCMLIEPPK

SEQ ID NO: 43604 - protein, 10 aa, Artificial Sequence
  Peptide Derived from Human Papillomavirus
EVQNDAQVLH

SEQ ID NO: 43605 - protein, 9 aa, Artificial Sequence
  Peptide Derived from Human Papillomavirus
FDKNGNPVY

SEQ ID NO: 43606 - protein, 8 aa, Artificial Sequence
  Peptide Derived from Human Papillomavirus
FFERTWSR

SEQ ID NO: 43607 - protein, 9 aa, Artificial Sequence
  Peptide Derived from Human Papillomavirus
FFVETIVEK

SEQ ID NO: 43608 - protein, 10 aa, Artificial Sequence
  Peptide Derived from Human Papillomavirus
FFVETIVEKK

SEQ ID NO: 43609 - protein, 9 aa, Artificial Sequence
  Peptide Derived from Human Papillomavirus
FISFLRALK

SEQ ID NO: 43610 - protein, 8 aa, Artificial Sequence
  Peptide Derived from Human Papillomavirus
FLKGTPKK

SEQ ID NO: 43611 - protein, 9 aa, Artificial Sequence
  Peptide Derived from Human Papillomavirus
FLKSNCQAK

SEQ ID NO: 43612 - protein, 10 aa, Artificial Sequence
  Peptide Derived from Human Papillomavirus
FLKSNCQAKY

SEQ ID NO: 43613 - protein, 10 aa, Artificial Sequence
  Peptide Derived from Human Papillomavirus
FLRALKEFLK

SEQ ID NO: 43614 - protein, 9 aa, Artificial Sequence
  Peptide Derived from Human Papillomavirus
FTDLVRNFK

SEQ ID NO: 43615 - protein, 11 aa, Artificial Sequence
  Peptide Derived from Human Papillomavirus
FTFPHAFPFDK

SEQ ID NO: 43616 - protein, 8 aa, Artificial Sequence
  Peptide Derived from Human Papillomavirus
FTISDSGY

SEQ ID NO: 43617 - protein, 8 aa, Artificial Sequence
  Peptide Derived from Human Papillomavirus
FVETIVEK

SEQ ID NO: 43618 - protein, 9 aa, Artificial Sequence
  Peptide Derived from Human Papillomavirus
FVETIVEKK

SEQ ID NO: 43619 - protein, 9 aa, Artificial Sequence
  Peptide Derived from Human Papillomavirus
GDTPEWIQR

SEQ ID NO: 43620 - protein, 11 aa, Artificial Sequence
  Peptide Derived from Human Papillomavirus
GDWRPIVQFLR

SEQ ID NO: 43621 - protein, 8 aa, Artificial Sequence
  Peptide Derived from Human Papillomavirus
GIPFGTFK

SEQ ID NO: 43622 - protein, 9 aa, Artificial Sequence
  Peptide Derived from Human Papillomavirus
GLSFTDLVR

SEQ ID NO: 43623 - protein, 8 aa, Artificial Sequence
  Peptide Derived from Human Papillomavirus
GNPISIDR

SEQ ID NO: 43624 - protein, 9 aa, Artificial Sequence
  Peptide Derived from Human Papillomavirus
GNPISIDRK

SEQ ID NO: 43625 - protein, 10 aa, Artificial Sequence
  Peptide Derived from Human Papillomavirus
GNPISIDRKH

SEQ ID NO: 43626 - protein, 11 aa, Artificial Sequence
  Peptide Derived from Human Papillomavirus
GNPISIDRKHK

SEQ ID NO: 43627 - protein, 10 aa, Artificial Sequence
  Peptide Derived from Human Papillomavirus
GNPVYEINDK

SEQ ID NO: 43628 - protein, 11 aa, Artificial Sequence
  Peptide Derived from Human Papillomavirus
GTPKKNCILLY

SEQ ID NO: 43629 - protein, 9 aa, Artificial Sequence
  Peptide Derived from Human Papillomavirus
GVEFISFLR

SEQ ID NO: 43630 - protein, 9 aa, Artificial Sequence
  Peptide Derived from Human Papillomavirus
GVLILALLR

SEQ ID NO: 43631 - protein, 10 aa, Artificial Sequence
  Peptide Derived from Human Papillomavirus
GVLILALLRY

SEQ ID NO: 43632 - protein, 11 aa, Artificial Sequence
  Peptide Derived from Human Papillomavirus
GVLILALLRYK

SEQ ID NO: 43633 - protein, 11 aa, Artificial Sequence
  Peptide Derived from Human Papillomavirus
GVNPTVAEGFK

SEQ ID NO: 43634 - protein, 8 aa, Artificial Sequence
  Peptide Derived from Human Papillomavirus
HCSITELK

SEQ ID NO: 43635 - protein, 11 aa, Artificial Sequence
  Peptide Derived from Human Papillomavirus
HFWLEPLADTK

SEQ ID NO: 43636 - protein, 8 aa, Artificial Sequence
  Peptide Derived from Human Papillomavirus
HIQCLDCK

SEQ ID NO: 43637 - protein, 10 aa, Artificial Sequence
  Peptide Derived from Human Papillomavirus
HTCWTYFDNY

SEQ ID NO: 43638 - protein, 8 aa, Artificial Sequence
  Peptide Derived from Human Papillomavirus
IDEGGDWR

SEQ ID NO: 43639 - protein, 8 aa, Artificial Sequence
  Peptide Derived from Human Papillomavirus
IDPAKDNK

SEQ ID NO: 43640 - protein, 11 aa, Artificial Sequence
  Peptide Derived from Human Papillomavirus
IDPAKDNKWPY

SEQ ID NO: 43641 - protein, 10 aa, Artificial Sequence
  Peptide Derived from Human Papillomavirus
IISFVNSNSH

SEQ ID NO: 43642 - protein, 8 aa, Artificial Sequence
  Peptide Derived from Human Papillomavirus
ILALLRYK

SEQ ID NO: 43643 - protein, 11 aa, Artificial Sequence
  Peptide Derived from Human Papillomavirus
ILALLRYKCGK

SEQ ID NO: 43644 - protein, 11 aa, Artificial Sequence
  Peptide Derived from Human Papillomavirus
ILLTSNIDPAK

SEQ ID NO: 43645 - protein, 11 aa, Artificial Sequence
  Peptide Derived from Human Papillomavirus
ILLYGPANTGK

SEQ ID NO: 43646 - protein, 8 aa, Artificial Sequence
  Peptide Derived from Human Papillomavirus
ISFLRALK

SEQ ID NO: 43647 - protein, 9 aa, Artificial Sequence
  Peptide Derived from Human Papillomavirus
ISFVNSNSH

SEQ ID NO: 43648 - protein, 8 aa, Artificial Sequence
  Peptide Derived from Human Papillomavirus
ISIDRKHK

SEQ ID NO: 43649 - protein, 8 aa, Artificial Sequence
  Peptide Derived from Human Papillomavirus
ISLNSGHK

SEQ ID NO: 43650 - protein, 9 aa, Artificial Sequence
  Peptide Derived from Human Papillomavirus
ISLNSGHKK

SEQ ID NO: 43651 - protein, 11 aa, Artificial Sequence
  Peptide Derived from Human Papillomavirus
ISLNSGHKKAK

SEQ ID NO: 43652 - protein, 9 aa, Artificial Sequence
  Peptide Derived from Human Papillomavirus
KAAMLAVFK

SEQ ID NO: 43653 - protein, 10 aa, Artificial Sequence
  Peptide Derived from Human Papillomavirus
KCFFERTWSR

SEQ ID NO: 43654 - protein, 11 aa, Artificial Sequence
  Peptide Derived from Human Papillomavirus
KCGKNRLTVAK

SEQ ID NO: 43655 - protein, 9 aa, Artificial Sequence
  Peptide Derived from Human Papillomavirus
KCVTGQNTR

SEQ ID NO: 43656 - protein, 8 aa, Artificial Sequence
  Peptide Derived from Human Papillomavirus
KDCAVMCR

SEQ ID NO: 43657 - protein, 9 aa, Artificial Sequence
  Peptide Derived from Human Papillomavirus
KDCAVMCRH

SEQ ID NO: 43658 - protein, 10 aa, Artificial Sequence
  Peptide Derived from Human Papillomavirus
KDCAVMCRHY

SEQ ID NO: 43659 - protein, 11 aa, Artificial Sequence
  Peptide Derived from Human Papillomavirus
KDCAVMCRHYK

SEQ ID NO: 43660 - protein, 11 aa, Artificial Sequence
  Peptide Derived from Human Papillomavirus
KDNKWPYLESR

SEQ ID NO: 43661 - protein, 8 aa, Artificial Sequence
  Peptide Derived from Human Papillomavirus
KGLSTLLH

SEQ ID NO: 43662 - protein, 9 aa, Artificial Sequence
  Peptide Derived from Human Papillomavirus
KIDEGGDWR

SEQ ID NO: 43663 - protein, 10 aa, Artificial Sequence
  Peptide Derived from Human Papillomavirus
KLRSSVAALY

SEQ ID NO: 43664 - protein, 8 aa, Artificial Sequence
  Peptide Derived from Human Papillomavirus
KNRLTVAK

SEQ ID NO: 43665 - protein, 9 aa, Artificial Sequence
  Peptide Derived from Human Papillomavirus
KNWKCFFER

SEQ ID NO: 43666 - protein, 8 aa, Artificial Sequence
  Peptide Derived from Human Papillomavirus
KSNCQAKY

SEQ ID NO: 43667 - protein, 10 aa, Artificial Sequence
  Peptide Derived from Human Papillomavirus
KSNCQAKYLK

SEQ ID NO: 43668 - protein, 10 aa, Artificial Sequence
  Peptide Derived from Human Papillomavirus
KSYFGMSFIH

SEQ ID NO: 43669 - protein, 10 aa, Artificial Sequence
  Peptide Derived from Human Papillomavirus
KTLIKPATLY

SEQ ID NO: 43670 - protein, 10 aa, Artificial Sequence
  Peptide Derived from Human Papillomavirus
KVAMLDDATH

SEQ ID NO: 43671 - protein, 10 aa, Artificial Sequence
  Peptide Derived from Human Papillomavirus
LALLRYKCGK

SEQ ID NO: 43672 - protein, 8 aa, Artificial Sequence
  Peptide Derived from Human Papillomavirus
LAVFKDIY

SEQ ID NO: 43673 - protein, 11 aa, Artificial Sequence
  Peptide Derived from Human Papillomavirus
LDDATHTCWTY

SEQ ID NO: 43674 - protein, 10 aa, Artificial Sequence
  Peptide Derived from Human Papillomavirus
LDGNPISIDR

SEQ ID NO: 43675 - protein, 11 aa, Artificial Sequence
  Peptide Derived from Human Papillomavirus
LDGNPISIDRK

SEQ ID NO: 43676 - protein, 9 aa, Artificial Sequence
  Peptide Derived from Human Papillomavirus
LFTISDSGY

SEQ ID NO: 43677 - protein, 8 aa, Artificial Sequence
  Peptide Derived from Human Papillomavirus
LIEPPKLR

SEQ ID NO: 43678 - protein, 8 aa, Artificial Sequence
  Peptide Derived from Human Papillomavirus
LIKPATLY

SEQ ID NO: 43679 - protein, 10 aa, Artificial Sequence
  Peptide Derived from Human Papillomavirus
LIKPATLYAH

SEQ ID NO: 43680 - protein, 8 aa, Artificial Sequence
  Peptide Derived from Human Papillomavirus
LILALLRY

SEQ ID NO: 43681 - protein, 9 aa, Artificial Sequence
  Peptide Derived from Human Papillomavirus
LILALLRYK

SEQ ID NO: 43682 - protein, 11 aa, Artificial Sequence
  Peptide Derived from Human Papillomavirus
LLKRKFAGGSK

SEQ ID NO: 43683 - protein, 8 aa, Artificial Sequence
  Peptide Derived from Human Papillomavirus
LLQASNKK

SEQ ID NO: 43684 - protein, 8 aa, Artificial Sequence
  Peptide Derived from Human Papillomavirus
LLRYKCGK

SEQ ID NO: 43685 - protein, 10 aa, Artificial Sequence
  Peptide Derived from Human Papillomavirus
LLRYKCGKNR

SEQ ID NO: 43686 - protein, 10 aa, Artificial Sequence
  Peptide Derived from Human Papillomavirus
LLTSNIDPAK

SEQ ID NO: 43687 - protein, 10 aa, Artificial Sequence
  Peptide Derived from Human Papillomavirus
LLYGPANTGK

SEQ ID NO: 43688 - protein, 9 aa, Artificial Sequence
  Peptide Derived from Human Papillomavirus
LNSGHKKAK

SEQ ID NO: 43689 - protein, 10 aa, Artificial Sequence
  Peptide Derived from Human Papillomavirus
LNSGHKKAKR

SEQ ID NO: 43690 - protein, 11 aa, Artificial Sequence
  Peptide Derived from Human Papillomavirus
LNSGHKKAKRR

SEQ ID NO: 43691 - protein, 8 aa, Artificial Sequence
  Peptide Derived from Human Papillomavirus
LSFTDLVR

SEQ ID NO: 43692 - protein, 11 aa, Artificial Sequence
  Peptide Derived from Human Papillomavirus
LSFTDLVRNFK

SEQ ID NO: 43693 - protein, 10 aa, Artificial Sequence
  Peptide Derived from Human Papillomavirus
LSVDTDLSPR

SEQ ID NO: 43694 - protein, 11 aa, Artificial Sequence
  Peptide Derived from Human Papillomavirus
LTDESDMAFQY

SEQ ID NO: 43695 - protein, 9 aa, Artificial Sequence
  Peptide Derived from Human Papillomavirus
LTSNIDPAK

SEQ ID NO: 43696 - protein, 9 aa, Artificial Sequence
  Peptide Derived from Human Papillomavirus
LVRNFKSDK

SEQ ID NO: 43697 - protein, 10 aa, Artificial Sequence
  Peptide Derived from Human Papillomavirus
MCRHYKRAQK

SEQ ID NO: 43698 - protein, 11 aa, Artificial Sequence
  Peptide Derived from Human Papillomavirus
MCRHYKRAQKR

SEQ ID NO: 43699 - protein, 9 aa, Artificial Sequence
  Peptide Derived from Human Papillomavirus
MLAVFKDIY

SEQ ID NO: 43700 - protein, 9 aa, Artificial Sequence
  Peptide Derived from Human Papillomavirus
MLIEPPKLR

SEQ ID NO: 43701 - protein, 8 aa, Artificial Sequence
  Peptide Derived from Human Papillomavirus
MNMSQWIK

SEQ ID NO: 43702 - protein, 9 aa, Artificial Sequence
  Peptide Derived from Human Papillomavirus
MNMSQWIKY

SEQ ID NO: 43703 - protein, 10 aa, Artificial Sequence
  Peptide Derived from Human Papillomavirus
MNMSQWIKYR

SEQ ID NO: 43704 - protein, 8 aa, Artificial Sequence
  Peptide Derived from Human Papillomavirus
MSQWIKYR

SEQ ID NO: 43705 - protein, 11 aa, Artificial Sequence
  Peptide Derived from Human Papillomavirus
MSQWIKYRCSK

SEQ ID NO: 43706 - protein, 9 aa, Artificial Sequence
  Peptide Derived from Human Papillomavirus
NAENGGSVH

SEQ ID NO: 43707 - protein, 8 aa, Artificial Sequence
  Peptide Derived from Human Papillomavirus
NAENVDPH

SEQ ID NO: 43708 - protein, 8 aa, Artificial Sequence
  Peptide Derived from Human Papillomavirus
NCQAKYLK

SEQ ID NO: 43709 - protein, 10 aa, Artificial Sequence
  Peptide Derived from Human Papillomavirus
NDAQVLHLLK

SEQ ID NO: 43710 - protein, 11 aa, Artificial Sequence
  Peptide Derived from Human Papillomavirus
NDAQVLHLLKR

SEQ ID NO: 43711 - protein, 11 aa, Artificial Sequence
  Peptide Derived from Human Papillomavirus
NDKNWKCFFER

SEQ ID NO: 43712 - protein, 11 aa, Artificial Sequence
  Peptide Derived from Human Papillomavirus
NGNPVYEINDK

SEQ ID NO: 43713 - protein, 9 aa, Artificial Sequence
  Peptide Derived from Human Papillomavirus
NIDPAKDNK

SEQ ID NO: 43714 - protein, 8 aa, Artificial Sequence
  Peptide Derived from Human Papillomavirus
NMSQWIKY

SEQ ID NO: 43715 - protein, 9 aa, Artificial Sequence
  Peptide Derived from Human Papillomavirus
NMSQWIKYR

SEQ ID NO: 43716 - protein, 8 aa, Artificial Sequence
  Peptide Derived from Human Papillomavirus
NSGHKKAK

SEQ ID NO: 43717 - protein, 9 aa, Artificial Sequence
  Peptide Derived from Human Papillomavirus
NSGHKKAKR

SEQ ID NO: 43718 - protein, 10 aa, Artificial Sequence
  Peptide Derived from Human Papillomavirus
NSGHKKAKRR

SEQ ID NO: 43719 - protein, 9 aa, Artificial Sequence
  Peptide Derived from Human Papillomavirus
NSNAAAFLK

SEQ ID NO: 43720 - protein, 11 aa, Artificial Sequence
  Peptide Derived from Human Papillomavirus
NTNAENGGSVH

SEQ ID NO: 43721 - protein, 9 aa, Artificial Sequence
  Peptide Derived from Human Papillomavirus
PAKDNKWPY

SEQ ID NO: 43722 - protein, 8 aa, Artificial Sequence
  Peptide Derived from Human Papillomavirus
PANTGKSY

SEQ ID NO: 43723 - protein, 10 aa, Artificial Sequence
  Peptide Derived from Human Papillomavirus
PFDKNGNPVY

SEQ ID NO: 43724 - protein, 8 aa, Artificial Sequence
  Peptide Derived from Human Papillomavirus
PISIDRKH

SEQ ID NO: 43725 - protein, 9 aa, Artificial Sequence
  Peptide Derived from Human Papillomavirus
PISIDRKHK

SEQ ID NO: 43726 - protein, 8 aa, Artificial Sequence
  Peptide Derived from Human Papillomavirus
PIVQFLRY

SEQ ID NO: 43727 - protein, 8 aa, Artificial Sequence
  Peptide Derived from Human Papillomavirus
PTVAEGFK

SEQ ID NO: 43728 - protein, 8 aa, Artificial Sequence
  Peptide Derived from Human Papillomavirus
PVYEINDK

SEQ ID NO: 43729 - protein, 11 aa, Artificial Sequence
  Peptide Derived from Human Papillomavirus
PVYEINDKNWK

SEQ ID NO: 43730 - protein, 10 aa, Artificial Sequence
  Peptide Derived from Human Papillomavirus
QGVEFISFLR

SEQ ID NO: 43731 - protein, 11 aa, Artificial Sequence
  Peptide Derived from Human Papillomavirus
QLSVDTDLSPR

SEQ ID NO: 43732 - protein, 9 aa, Artificial Sequence
  Peptide Derived from Human Papillomavirus
QMNMSQWIK

SEQ ID NO: 43733 - protein, 10 aa, Artificial Sequence
  Peptide Derived from Human Papillomavirus
QMNMSQWIKY

SEQ ID NO: 43734 - protein, 11 aa, Artificial Sequence
  Peptide Derived from Human Papillomavirus
QMNMSQWIKYR

SEQ ID NO: 43735 - protein, 8 aa, Artificial Sequence
  Peptide Derived from Human Papillomavirus
QNDAQVLH

SEQ ID NO: 43736 - protein, 11 aa, Artificial Sequence
  Peptide Derived from Human Papillomavirus
QNDAQVLHLLK

SEQ ID NO: 43737 - protein, 8 aa, Artificial Sequence
  Peptide Derived from Human Papillomavirus
QVLHLLKR

SEQ ID NO: 43738 - protein, 9 aa, Artificial Sequence
  Peptide Derived from Human Papillomavirus
QVLHLLKRK

SEQ ID NO: 43739 - protein, 8 aa, Artificial Sequence
  Peptide Derived from Human Papillomavirus
RALKEFLK

SEQ ID NO: 43740 - protein, 10 aa, Artificial Sequence
  Peptide Derived from Human Papillomavirus
RLFTISDSGY

SEQ ID NO: 43741 - protein, 11 aa, Artificial Sequence
  Peptide Derived from Human Papillomavirus
RLQEISLNSGH

SEQ ID NO: 43742 - protein, 8 aa, Artificial Sequence
  Peptide Derived from Human Papillomavirus
RSSVAALY

SEQ ID NO: 43743 - protein, 10 aa, Artificial Sequence
  Peptide Derived from Human Papillomavirus
RSSVAALYWY

SEQ ID NO: 43744 - protein, 11 aa, Artificial Sequence
  Peptide Derived from Human Papillomavirus
RSSVAALYWYR

SEQ ID NO: 43745 - protein, 9 aa, Artificial Sequence
  Peptide Derived from Human Papillomavirus
RTWSRLDLH

SEQ ID NO: 43746 - protein, 9 aa, Artificial Sequence
  Peptide Derived from Human Papillomavirus
RVTVFTFPH

SEQ ID NO: 43747 - protein, 10 aa, Artificial Sequence
  Peptide Derived from Human Papillomavirus
SDNAENVDPH

SEQ ID NO: 43748 - protein, 11 aa, Artificial Sequence
  Peptide Derived from Human Papillomavirus
SFLRALKEFLK

SEQ ID NO: 43749 - protein, 10 aa, Artificial Sequence
  Peptide Derived from Human Papillomavirus
SFTDLVRNFK

SEQ ID NO: 43750 - protein, 8 aa, Artificial Sequence
  Peptide Derived from Human Papillomavirus
SFVNSNSH

SEQ ID NO: 43751 - protein, 10 aa, Artificial Sequence
  Peptide Derived from Human Papillomavirus
SGDTPEWIQR

SEQ ID NO: 43752 - protein, 8 aa, Artificial Sequence
  Peptide Derived from Human Papillomavirus
SGHKKAKR

SEQ ID NO: 43753 - protein, 9 aa, Artificial Sequence
  Peptide Derived from Human Papillomavirus
SGHKKAKRR

SEQ ID NO: 43754 - protein, 8 aa, Artificial Sequence
  Peptide Derived from Human Papillomavirus
SLNSGHKK

SEQ ID NO: 43755 - protein, 10 aa, Artificial Sequence
  Peptide Derived from Human Papillomavirus
SLNSGHKKAK

SEQ ID NO: 43756 - protein, 11 aa, Artificial Sequence
  Peptide Derived from Human Papillomavirus
SLNSGHKKAKR

SEQ ID NO: 43757 - protein, 8 aa, Artificial Sequence
  Peptide Derived from Human Papillomavirus
SNAAAFLK

SEQ ID NO: 43758 - protein, 9 aa, Artificial Sequence
  Peptide Derived from Human Papillomavirus
SNCQAKYLK

SEQ ID NO: 43759 - protein, 10 aa, Artificial Sequence
  Peptide Derived from Human Papillomavirus
SNIDPAKDNK

SEQ ID NO: 43760 - protein, 11 aa, Artificial Sequence
  Peptide Derived from Human Papillomavirus
SSDNAENVDPH

SEQ ID NO: 43761 - protein, 9 aa, Artificial Sequence
  Peptide Derived from Human Papillomavirus
SSVAALYWY

SEQ ID NO: 43762 - protein, 10 aa, Artificial Sequence
  Peptide Derived from Human Papillomavirus
SSVAALYWYR

SEQ ID NO: 43763 - protein, 8 aa, Artificial Sequence
  Peptide Derived from Human Papillomavirus
SVAALYWY

SEQ ID NO: 43764 - protein, 9 aa, Artificial Sequence
  Peptide Derived from Human Papillomavirus
SVAALYWYR

SEQ ID NO: 43765 - protein, 9 aa, Artificial Sequence
  Peptide Derived from Human Papillomavirus
SVDTDLSPR

SEQ ID NO: 43766 - protein, 9 aa, Artificial Sequence
  Peptide Derived from Human Papillomavirus
TCMLIEPPK

SEQ ID NO: 43767 - protein, 11 aa, Artificial Sequence
  Peptide Derived from Human Papillomavirus
TCMLIEPPKLR

SEQ ID NO: 43768 - protein, 9 aa, Artificial Sequence
  Peptide Derived from Human Papillomavirus
TCWTYFDNY

SEQ ID NO: 43769 - protein, 11 aa, Artificial Sequence
  Peptide Derived from Human Papillomavirus
TCWTYFDNYMR

SEQ ID NO: 43770 - protein, 10 aa, Artificial Sequence
  Peptide Derived from Human Papillomavirus
TDESDMAFQY

SEQ ID NO: 43771 - protein, 8 aa, Artificial Sequence
  Peptide Derived from Human Papillomavirus
TDLVRNFK

SEQ ID NO: 43772 - protein, 11 aa, Artificial Sequence
  Peptide Derived from Human Papillomavirus
TDLVRNFKSDK

SEQ ID NO: 43773 - protein, 11 aa, Artificial Sequence
  Peptide Derived from Human Papillomavirus
TFKCVTGQNTR

SEQ ID NO: 43774 - protein, 10 aa, Artificial Sequence
  Peptide Derived from Human Papillomavirus
TFPHAFPFDK

SEQ ID NO: 43775 - protein, 9 aa, Artificial Sequence
  Peptide Derived from Human Papillomavirus
TLIKPATLY

SEQ ID NO: 43776 - protein, 11 aa, Artificial Sequence
  Peptide Derived from Human Papillomavirus
TLIKPATLYAH

SEQ ID NO: 43777 - protein, 10 aa, Artificial Sequence
  Peptide Derived from Human Papillomavirus
TNAENGGSVH

SEQ ID NO: 43778 - protein, 8 aa, Artificial Sequence
  Peptide Derived from Human Papillomavirus
TSNIDPAK

SEQ ID NO: 43779 - protein, 11 aa, Artificial Sequence
  Peptide Derived from Human Papillomavirus
TSNIDPAKDNK

SEQ ID NO: 43780 - protein, 11 aa, Artificial Sequence
  Peptide Derived from Human Papillomavirus
TVAEGFKTLIK

SEQ ID NO: 43781 - protein, 11 aa, Artificial Sequence
  Peptide Derived from Human Papillomavirus
TVAKGLSTLLH

SEQ ID NO: 43782 - protein, 8 aa, Artificial Sequence
  Peptide Derived from Human Papillomavirus
VAALYWYR

SEQ ID NO: 43783 - protein, 10 aa, Artificial Sequence
  Peptide Derived from Human Papillomavirus
VAEGFKTLIK

SEQ ID NO: 43784 - protein, 10 aa, Artificial Sequence
  Peptide Derived from Human Papillomavirus
VAKGLSTLLH

SEQ ID NO: 43785 - protein, 9 aa, Artificial Sequence
  Peptide Derived from Human Papillomavirus
VAMLDDATH

SEQ ID NO: 43786 - protein, 11 aa, Artificial Sequence
  Peptide Derived from Human Papillomavirus
VDPHCSITELK

SEQ ID NO: 43787 - protein, 8 aa, Artificial Sequence
  Peptide Derived from Human Papillomavirus
VDTDLSPR

SEQ ID NO: 43788 - protein, 8 aa, Artificial Sequence
  Peptide Derived from Human Papillomavirus
VLHLLKRK

SEQ ID NO: 43789 - protein, 8 aa, Artificial Sequence
  Peptide Derived from Human Papillomavirus
VLILALLR

SEQ ID NO: 43790 - protein, 9 aa, Artificial Sequence
  Peptide Derived from Human Papillomavirus
VLILALLRY

SEQ ID NO: 43791 - protein, 10 aa, Artificial Sequence
  Peptide Derived from Human Papillomavirus
VLILALLRYK

SEQ ID NO: 43792 - protein, 8 aa, Artificial Sequence
  Peptide Derived from Human Papillomavirus
VMCRHYKR

SEQ ID NO: 43793 - protein, 11 aa, Artificial Sequence
  Peptide Derived from Human Papillomavirus
VMCRHYKRAQK

SEQ ID NO: 43794 - protein, 10 aa, Artificial Sequence
  Peptide Derived from Human Papillomavirus
VNPTVAEGFK

SEQ ID NO: 43795 - protein, 11 aa, Artificial Sequence
  Peptide Derived from Human Papillomavirus
VSGDTPEWIQR

SEQ ID NO: 43796 - protein, 8 aa, Artificial Sequence
  Peptide Derived from Human Papillomavirus
VTVFTFPH

SEQ ID NO: 43797 - protein, 10 aa, Artificial Sequence
  Peptide Derived from Human Papillomavirus
WFFVETIVEK

SEQ ID NO: 43798 - protein, 11 aa, Artificial Sequence
  Peptide Derived from Human Papillomavirus
WFFVETIVEKK

SEQ ID NO: 43799 - protein, 10 aa, Artificial Sequence
  Peptide Derived from Human Papillomavirus
WGVLILALLR

SEQ ID NO: 43800 - protein, 11 aa, Artificial Sequence
  Peptide Derived from Human Papillomavirus
WGVLILALLRY

SEQ ID NO: 43801 - protein, 8 aa, Artificial Sequence
  Peptide Derived from Human Papillomavirus
WIKYRCSK

SEQ ID NO: 43802 - protein, 10 aa, Artificial Sequence
  Peptide Derived from Human Papillomavirus
WIQRLTIIQH

SEQ ID NO: 43803 - protein, 9 aa, Artificial Sequence
  Peptide Derived from Human Papillomavirus
WLEPLADTK

SEQ ID NO: 43804 - protein, 9 aa, Artificial Sequence
  Peptide Derived from Human Papillomavirus
WTYFDNYMR

SEQ ID NO: 43805 - protein, 10 aa, Artificial Sequence
  Peptide Derived from Human Papillomavirus
YAHIQCLDCK

SEQ ID NO: 43806 - protein, 8 aa, Artificial Sequence
  Peptide Derived from Human Papillomavirus
YFGMSFIH

SEQ ID NO: 43807 - protein, 10 aa, Artificial Sequence
  Peptide Derived from Human Papillomavirus
YGLSFTDLVR

SEQ ID NO: 43808 - protein, 8 aa, Artificial Sequence
  Peptide Derived from Human Papillomavirus
YGPANTGK

SEQ ID NO: 43809 - protein, 10 aa, Artificial Sequence
  Peptide Derived from Human Papillomavirus
YGPANTGKSY

SEQ ID NO: 43810 - protein, 10 aa, Artificial Sequence
  Peptide Derived from Human Papillomavirus
YLKDCAVMCR

SEQ ID NO: 43811 - protein, 11 aa, Artificial Sequence
  Peptide Derived from Human Papillomavirus
YLKDCAVMCRH

SEQ ID NO: 43812 - protein, 10 aa, Artificial Sequence
  Peptide Derived from Human Papillomavirus
AACVSYWGVY

SEQ ID NO: 43813 - protein, 11 aa, Artificial Sequence
  Peptide Derived from Human Papillomavirus
AACVSYWGVYY

SEQ ID NO: 43814 - protein, 9 aa, Artificial Sequence
  Peptide Derived from Human Papillomavirus
ACVSYWGVY

SEQ ID NO: 43815 - protein, 10 aa, Artificial Sequence
  Peptide Derived from Human Papillomavirus
ACVSYWGVYY

SEQ ID NO: 43816 - protein, 9 aa, Artificial Sequence
  Peptide Derived from Human Papillomavirus
AIELQMALK

SEQ ID NO: 43817 - protein, 9 aa, Artificial Sequence
  Peptide Derived from Human Papillomavirus
AILFTAREH

SEQ ID NO: 43818 - protein, 9 aa, Artificial Sequence
  Peptide Derived from Human Papillomavirus
ALKGLAQSK

SEQ ID NO: 43819 - protein, 10 aa, Artificial Sequence
  Peptide Derived from Human Papillomavirus
ALKGLAQSKY

SEQ ID NO: 43820 - protein, 9 aa, Artificial Sequence
  Peptide Derived from Human Papillomavirus
ALQDKILDH

SEQ ID NO: 43821 - protein, 10 aa, Artificial Sequence
  Peptide Derived from Human Papillomavirus
ALQDKILDHY

SEQ ID NO: 43822 - protein, 9 aa, Artificial Sequence
  Peptide Derived from Human Papillomavirus
ASVGTPKPH

SEQ ID NO: 43823 - protein, 10 aa, Artificial Sequence
  Peptide Derived from Human Papillomavirus
ATQIVRQLQH

SEQ ID NO: 43824 - protein, 10 aa, Artificial Sequence
  Peptide Derived from Human Papillomavirus
CFKKGGKTVH

SEQ ID NO: 43825 - protein, 8 aa, Artificial Sequence
  Peptide Derived from Human Papillomavirus
CGLTEQHH

SEQ ID NO: 43826 - protein, 10 aa, Artificial Sequence
  Peptide Derived from Human Papillomavirus
CGLTEQHHGR

SEQ ID NO: 43827 - protein, 8 aa, Artificial Sequence
  Peptide Derived from Human Papillomavirus
CLRYRLRK

SEQ ID NO: 43828 - protein, 9 aa, Artificial Sequence
  Peptide Derived from Human Papillomavirus
CLRYRLRKY

SEQ ID NO: 43829 - protein, 11 aa, Artificial Sequence
  Peptide Derived from Human Papillomavirus
CMNYVVWDSIY

SEQ ID NO: 43830 - protein, 10 aa, Artificial Sequence
  Peptide Derived from Human Papillomavirus
CSGNTTPIIH

SEQ ID NO: 43831 - protein, 8 aa, Artificial Sequence
  Peptide Derived from Human Papillomavirus
CSSTSNNK

SEQ ID NO: 43832 - protein, 9 aa, Artificial Sequence
  Peptide Derived from Human Papillomavirus
CSSTSNNKR

SEQ ID NO: 43833 - protein, 10 aa, Artificial Sequence
  Peptide Derived from Human Papillomavirus
CSSTSNNKRR

SEQ ID NO: 43834 - protein, 11 aa, Artificial Sequence
  Peptide Derived from Human Papillomavirus
CSSTSNNKRRK

SEQ ID NO: 43835 - protein, 8 aa, Artificial Sequence
  Peptide Derived from Human Papillomavirus
CVSYWGVY

SEQ ID NO: 43836 - protein, 9 aa, Artificial Sequence
  Peptide Derived from Human Papillomavirus
CVSYWGVYY

SEQ ID NO: 43837 - protein, 11 aa, Artificial Sequence
  Peptide Derived from Human Papillomavirus
CVSYWGVYYIK

SEQ ID NO: 43838 - protein, 11 aa, Artificial Sequence
  Peptide Derived from Human Papillomavirus
DDTVSATQIVR

SEQ ID NO: 43839 - protein, 11 aa, Artificial Sequence
  Peptide Derived from Human Papillomavirus
DGDTTYYVQFK

SEQ ID NO: 43840 - protein, 10 aa, Artificial Sequence
  Peptide Derived from Human Papillomavirus
DGNKDNCMNY

SEQ ID NO: 43841 - protein, 8 aa, Artificial Sequence
  Peptide Derived from Human Papillomavirus
DINSQISY

SEQ ID NO: 43842 - protein, 11 aa, Artificial Sequence
  Peptide Derived from Human Papillomavirus
DSKDINSQISY

SEQ ID NO: 43843 - protein, 9 aa, Artificial Sequence
  Peptide Derived from Human Papillomavirus
DTTYYVQFK

SEQ ID NO: 43844 - protein, 10 aa, Artificial Sequence
  Peptide Derived from Human Papillomavirus
DTVSATQIVR

SEQ ID NO: 43845 - protein, 9 aa, Artificial Sequence
  Peptide Derived from Human Papillomavirus
ENAILFTAR

SEQ ID NO: 43846 - protein, 11 aa, Artificial Sequence
  Peptide Derived from Human Papillomavirus
ENAILFTAREH

SEQ ID NO: 43847 - protein, 11 aa, Artificial Sequence
  Peptide Derived from Human Papillomavirus
FDGNKDNCMNY

SEQ ID NO: 43848 - protein, 10 aa, Artificial Sequence
  Peptide Derived from Human Papillomavirus
FTAREHGITK

SEQ ID NO: 43849 - protein, 10 aa, Artificial Sequence
  Peptide Derived from Human Papillomavirus
GDKNSLKCLR

SEQ ID NO: 43850 - protein, 11 aa, Artificial Sequence
  Peptide Derived from Human Papillomavirus
GDKNSLKCLRY

SEQ ID NO: 43851 - protein, 10 aa, Artificial Sequence
  Peptide Derived from Human Papillomavirus
GDTTYYVQFK

SEQ ID NO: 43852 - protein, 8 aa, Artificial Sequence
  Peptide Derived from Human Papillomavirus
GGKTVHVY

SEQ ID NO: 43853 - protein, 9 aa, Artificial Sequence
  Peptide Derived from Human Papillomavirus
GLTEQHHGR

SEQ ID NO: 43854 - protein, 9 aa, Artificial Sequence
  Peptide Derived from Human Papillomavirus
GNKDNCMNY

SEQ ID NO: 43855 - protein, 10 aa, Artificial Sequence
  Peptide Derived from Human Papillomavirus
GNSNTWEVQY

SEQ ID NO: 43856 - protein, 8 aa, Artificial Sequence
  Peptide Derived from Human Papillomavirus
GNTTPIIH

SEQ ID NO: 43857 - protein, 10 aa, Artificial Sequence
  Peptide Derived from Human Papillomavirus
GNTTPIIHLK

SEQ ID NO: 43858 - protein, 8 aa, Artificial Sequence
  Peptide Derived from Human Papillomavirus
HASTSTPK

SEQ ID NO: 43859 - protein, 8 aa, Artificial Sequence
  Peptide Derived from Human Papillomavirus
HGITKLNH

SEQ ID NO: 43860 - protein, 9 aa, Artificial Sequence
  Peptide Derived from Human Papillomavirus
HGRVNTHVH

SEQ ID NO: 43861 - protein, 8 aa, Artificial Sequence
  Peptide Derived from Human Papillomavirus
HIQTPATK

SEQ ID NO: 43862 - protein, 9 aa, Artificial Sequence
  Peptide Derived from Human Papillomavirus
HIQTPATKR

SEQ ID NO: 43863 - protein, 11 aa, Artificial Sequence
  Peptide Derived from Human Papillomavirus
HIQTPATKRPR

SEQ ID NO: 43864 - protein, 10 aa, Artificial Sequence
  Peptide Derived from Human Papillomavirus
HLKGDKNSLK

SEQ ID NO: 43865 - protein, 8 aa, Artificial Sequence
  Peptide Derived from Human Papillomavirus
HVYFDGNK

SEQ ID NO: 43866 - protein, 8 aa, Artificial Sequence
  Peptide Derived from Human Papillomavirus
IIHLKGDK

SEQ ID NO: 43867 - protein, 10 aa, Artificial Sequence
  Peptide Derived from Human Papillomavirus
ILDHYENDSK

SEQ ID NO: 43868 - protein, 8 aa, Artificial Sequence
  Peptide Derived from Human Papillomavirus
ILFTAREH

SEQ ID NO: 43869 - protein, 9 aa, Artificial Sequence
  Peptide Derived from Human Papillomavirus
INISKSKAH

SEQ ID NO: 43870 - protein, 10 aa, Artificial Sequence
  Peptide Derived from Human Papillomavirus
INISKSKAHK

SEQ ID NO: 43871 - protein, 8 aa, Artificial Sequence
  Peptide Derived from Human Papillomavirus
ISKSKAHK

SEQ ID NO: 43872 - protein, 8 aa, Artificial Sequence
  Peptide Derived from Human Papillomavirus
ISYWQLIR

SEQ ID NO: 43873 - protein, 9 aa, Artificial Sequence
  Peptide Derived from Human Papillomavirus
ITETGIWDK

SEQ ID NO: 43874 - protein, 10 aa, Artificial Sequence
  Peptide Derived from Human Papillomavirus
KAIELQMALK

SEQ ID NO: 43875 - protein, 8 aa, Artificial Sequence
  Peptide Derived from Human Papillomavirus
KCLRYRLR

SEQ ID NO: 43876 - protein, 9 aa, Artificial Sequence
  Peptide Derived from Human Papillomavirus
KCLRYRLRK

SEQ ID NO: 43877 - protein, 10 aa, Artificial Sequence
  Peptide Derived from Human Papillomavirus
KCLRYRLRKY

SEQ ID NO: 43878 - protein, 8 aa, Artificial Sequence
  Peptide Derived from Human Papillomavirus
KDGDTTYY

SEQ ID NO: 43879 - protein, 9 aa, Artificial Sequence
  Peptide Derived from Human Papillomavirus
KDINSQISY

SEQ ID NO: 43880 - protein, 8 aa, Artificial Sequence
  Peptide Derived from Human Papillomavirus
KGDKNSLK

SEQ ID NO: 43881 - protein, 11 aa, Artificial Sequence
  Peptide Derived from Human Papillomavirus
KGDKNSLKCLR

SEQ ID NO: 43882 - protein, 9 aa, Artificial Sequence
  Peptide Derived from Human Papillomavirus
KGGKTVHVY

SEQ ID NO: 43883 - protein, 8 aa, Artificial Sequence
  Peptide Derived from Human Papillomavirus
KGLAQSKY

SEQ ID NO: 43884 - protein, 11 aa, Artificial Sequence
  Peptide Derived from Human Papillomavirus
KILDHYENDSK

SEQ ID NO: 43885 - protein, 8 aa, Artificial Sequence
  Peptide Derived from Human Papillomavirus
KNSLKCLR

SEQ ID NO: 43886 - protein, 9 aa, Artificial Sequence
  Peptide Derived from Human Papillomavirus
KNSLKCLRY

SEQ ID NO: 43887 - protein, 10 aa, Artificial Sequence
  Peptide Derived from Human Papillomavirus
KNSLKCLRYR

SEQ ID NO: 43888 - protein, 10 aa, Artificial Sequence
  Peptide Derived from Human Papillomavirus
KNTGILTVTY

SEQ ID NO: 43889 - protein, 8 aa, Artificial Sequence
  Peptide Derived from Human Papillomavirus
KTAACVSY

SEQ ID NO: 43890 - protein, 9 aa, Artificial Sequence
  Peptide Derived from Human Papillomavirus
KTASVGTPK

SEQ ID NO: 43891 - protein, 11 aa, Artificial Sequence
  Peptide Derived from Human Papillomavirus
KTASVGTPKPH

SEQ ID NO: 43892 - protein, 11 aa, Artificial Sequence
  Peptide Derived from Human Papillomavirus
KTVHVYFDGNK

SEQ ID NO: 43893 - protein, 9 aa, Artificial Sequence
  Peptide Derived from Human Papillomavirus
LCSSTSNNK

SEQ ID NO: 43894 - protein, 10 aa, Artificial Sequence
  Peptide Derived from Human Papillomavirus
LCSSTSNNKR

SEQ ID NO: 43895 - protein, 11 aa, Artificial Sequence
  Peptide Derived from Human Papillomavirus
LCSSTSNNKRR

SEQ ID NO: 43896 - protein, 9 aa, Artificial Sequence
  Peptide Derived from Human Papillomavirus
LDHYENDSK

SEQ ID NO: 43897 - protein, 11 aa, Artificial Sequence
  Peptide Derived from Human Papillomavirus
LFTAREHGITK

SEQ ID NO: 43898 - protein, 10 aa, Artificial Sequence
  Peptide Derived from Human Papillomavirus
LLCSSTSNNK

SEQ ID NO: 43899 - protein, 11 aa, Artificial Sequence
  Peptide Derived from Human Papillomavirus
LLCSSTSNNKR

SEQ ID NO: 43900 - protein, 11 aa, Artificial Sequence
  Peptide Derived from Human Papillomavirus
LSALQDKILDH

SEQ ID NO: 43901 - protein, 11 aa, Artificial Sequence
  Peptide Derived from Human Papillomavirus
LSERLSALQDK

SEQ ID NO: 43902 - protein, 8 aa, Artificial Sequence
  Peptide Derived from Human Papillomavirus
LTEQHHGR

SEQ ID NO: 43903 - protein, 11 aa, Artificial Sequence
  Peptide Derived from Human Papillomavirus
LTVTYNSEVQR

SEQ ID NO: 43904 - protein, 10 aa, Artificial Sequence
  Peptide Derived from Human Papillomavirus
MALKGLAQSK

SEQ ID NO: 43905 - protein, 11 aa, Artificial Sequence
  Peptide Derived from Human Papillomavirus
MALKGLAQSKY

SEQ ID NO: 43906 - protein, 10 aa, Artificial Sequence
  Peptide Derived from Human Papillomavirus
MNYVVWDSIY

SEQ ID NO: 43907 - protein, 11 aa, Artificial Sequence
  Peptide Derived from Human Papillomavirus
MNYVVWDSIYY

SEQ ID NO: 43908 - protein, 8 aa, Artificial Sequence
  Peptide Derived from Human Papillomavirus
NAILFTAR

SEQ ID NO: 43909 - protein, 10 aa, Artificial Sequence
  Peptide Derived from Human Papillomavirus
NAILFTAREH

SEQ ID NO: 43910 - protein, 8 aa, Artificial Sequence
  Peptide Derived from Human Papillomavirus
NISKSKAH

SEQ ID NO: 43911 - protein, 9 aa, Artificial Sequence
  Peptide Derived from Human Papillomavirus
NISKSKAHK

SEQ ID NO: 43912 - protein, 8 aa, Artificial Sequence
  Peptide Derived from Human Papillomavirus
NSLKCLRY

SEQ ID NO: 43913 - protein, 9 aa, Artificial Sequence
  Peptide Derived from Human Papillomavirus
NSLKCLRYR

SEQ ID NO: 43914 - protein, 11 aa, Artificial Sequence
  Peptide Derived from Human Papillomavirus
NSLKCLRYRLR

SEQ ID NO: 43915 - protein, 9 aa, Artificial Sequence
  Peptide Derived from Human Papillomavirus
NSNTWEVQY

SEQ ID NO: 43916 - protein, 11 aa, Artificial Sequence
  Peptide Derived from Human Papillomavirus
NSQISYWQLIR

SEQ ID NO: 43917 - protein, 9 aa, Artificial Sequence
  Peptide Derived from Human Papillomavirus
NSVQISVGY

SEQ ID NO: 43918 - protein, 9 aa, Artificial Sequence
  Peptide Derived from Human Papillomavirus
NTEPSQCFK

SEQ ID NO: 43919 - protein, 10 aa, Artificial Sequence
  Peptide Derived from Human Papillomavirus
NTEPSQCFKK

SEQ ID NO: 43920 - protein, 9 aa, Artificial Sequence
  Peptide Derived from Human Papillomavirus
NTGILTVTY

SEQ ID NO: 43921 - protein, 9 aa, Artificial Sequence
  Peptide Derived from Human Papillomavirus
NTTPIIHLK

SEQ ID NO: 43922 - protein, 9 aa, Artificial Sequence
  Peptide Derived from Human Papillomavirus
PIIHLKGDK

SEQ ID NO: 43923 - protein, 8 aa, Artificial Sequence
  Peptide Derived from Human Papillomavirus
PINISKSK

SEQ ID NO: 43924 - protein, 10 aa, Artificial Sequence
  Peptide Derived from Human Papillomavirus
PINISKSKAH

SEQ ID NO: 43925 - protein, 11 aa, Artificial Sequence
  Peptide Derived from Human Papillomavirus
PINISKSKAHK

SEQ ID NO: 43926 - protein, 11 aa, Artificial Sequence
  Peptide Derived from Human Papillomavirus
PLLCSSTSNNK

SEQ ID NO: 43927 - protein, 10 aa, Artificial Sequence
  Peptide Derived from Human Papillomavirus
PNSVQISVGY

SEQ ID NO: 43928 - protein, 10 aa, Artificial Sequence
  Peptide Derived from Human Papillomavirus
PSQCFKKGGK

SEQ ID NO: 43929 - protein, 8 aa, Artificial Sequence
  Peptide Derived from Human Papillomavirus
QCFKKGGK

SEQ ID NO: 43930 - protein, 11 aa, Artificial Sequence
  Peptide Derived from Human Papillomavirus
QCFKKGGKTVH

SEQ ID NO: 43931 - protein, 8 aa, Artificial Sequence
  Peptide Derived from Human Papillomavirus
QCGLTEQH

SEQ ID NO: 43932 - protein, 9 aa, Artificial Sequence
  Peptide Derived from Human Papillomavirus
QCGLTEQHH

SEQ ID NO: 43933 - protein, 11 aa, Artificial Sequence
  Peptide Derived from Human Papillomavirus
QCGLTEQHHGR

SEQ ID NO: 43934 - protein, 8 aa, Artificial Sequence
  Peptide Derived from Human Papillomavirus
QDKILDHY

SEQ ID NO: 43935 - protein, 8 aa, Artificial Sequence
  Peptide Derived from Human Papillomavirus
QFKSECEK

SEQ ID NO: 43936 - protein, 9 aa, Artificial Sequence
  Peptide Derived from Human Papillomavirus
QFKSECEKY

SEQ ID NO: 43937 - protein, 9 aa, Artificial Sequence
  Peptide Derived from Human Papillomavirus
QISYWQLIR

SEQ ID NO: 43938 - protein, 8 aa, Artificial Sequence
  Peptide Derived from Human Papillomavirus
QIVRQLQH

SEQ ID NO: 43939 - protein, 11 aa, Artificial Sequence
  Peptide Derived from Human Papillomavirus
QLQHASTSTPK

SEQ ID NO: 43940 - protein, 11 aa, Artificial Sequence
  Peptide Derived from Human Papillomavirus
QMALKGLAQSK

SEQ ID NO: 43941 - protein, 9 aa, Artificial Sequence
  Peptide Derived from Human Papillomavirus
QTPATKRPR

SEQ ID NO: 43942 - protein, 10 aa, Artificial Sequence
  Peptide Derived from Human Papillomavirus
QTPKESLSER

SEQ ID NO: 43943 - protein, 10 aa, Artificial Sequence
  Peptide Derived from Human Papillomavirus
QVVPPINISK

SEQ ID NO: 43944 - protein, 11 aa, Artificial Sequence
  Peptide Derived from Human Papillomavirus
RLENAILFTAR

SEQ ID NO: 43945 - protein, 8 aa, Artificial Sequence
  Peptide Derived from Human Papillomavirus
RLRKYADH

SEQ ID NO: 43946 - protein, 9 aa, Artificial Sequence
  Peptide Derived from Human Papillomavirus
RLRKYADHY

SEQ ID NO: 43947 - protein, 8 aa, Artificial Sequence
  Peptide Derived from Human Papillomavirus
RLSALQDK

SEQ ID NO: 43948 - protein, 10 aa, Artificial Sequence
  Peptide Derived from Human Papillomavirus
SALQDKILDH

SEQ ID NO: 43949 - protein, 11 aa, Artificial Sequence
  Peptide Derived from Human Papillomavirus
SALQDKILDHY

SEQ ID NO: 43950 - protein, 11 aa, Artificial Sequence
  Peptide Derived from Human Papillomavirus
SATQIVRQLQH

SEQ ID NO: 43951 - protein, 9 aa, Artificial Sequence
  Peptide Derived from Human Papillomavirus
SGNTTPIIH

SEQ ID NO: 43952 - protein, 11 aa, Artificial Sequence
  Peptide Derived from Human Papillomavirus
SGNTTPIIHLK

SEQ ID NO: 43953 - protein, 8 aa, Artificial Sequence
  Peptide Derived from Human Papillomavirus
SLKCLRYR

SEQ ID NO: 43954 - protein, 10 aa, Artificial Sequence
  Peptide Derived from Human Papillomavirus
SLKCLRYRLR

SEQ ID NO: 43955 - protein, 11 aa, Artificial Sequence
  Peptide Derived from Human Papillomavirus
SLKCLRYRLRK

SEQ ID NO: 43956 - protein, 8 aa, Artificial Sequence
  Peptide Derived from Human Papillomavirus
SNTWEVQY

SEQ ID NO: 43957 - protein, 8 aa, Artificial Sequence
  Peptide Derived from Human Papillomavirus
SSTSNNKR

SEQ ID NO: 43958 - protein, 9 aa, Artificial Sequence
  Peptide Derived from Human Papillomavirus
SSTSNNKRR

SEQ ID NO: 43959 - protein, 10 aa, Artificial Sequence
  Peptide Derived from Human Papillomavirus
SSTSNNKRRK

SEQ ID NO: 43960 - protein, 11 aa, Artificial Sequence
  Peptide Derived from Human Papillomavirus
SSTWHWTGCNK

SEQ ID NO: 43961 - protein, 8 aa, Artificial Sequence
  Peptide Derived from Human Papillomavirus
STSNNKRR

SEQ ID NO: 43962 - protein, 9 aa, Artificial Sequence
  Peptide Derived from Human Papillomavirus
STSNNKRRK

SEQ ID NO: 43963 - protein, 10 aa, Artificial Sequence
  Peptide Derived from Human Papillomavirus
STWHWTGCNK

SEQ ID NO: 43964 - protein, 8 aa, Artificial Sequence
  Peptide Derived from Human Papillomavirus
SVGTPKPH

SEQ ID NO: 43965 - protein, 8 aa, Artificial Sequence
  Peptide Derived from Human Papillomavirus
SVQISVGY

SEQ ID NO: 43966 - protein, 11 aa, Artificial Sequence
  Peptide Derived from Human Papillomavirus
TAACVSYWGVY

SEQ ID NO: 43967 - protein, 9 aa, Artificial Sequence
  Peptide Derived from Human Papillomavirus
TAREHGITK

SEQ ID NO: 43968 - protein, 8 aa, Artificial Sequence
  Peptide Derived from Human Papillomavirus
TASVGTPK

SEQ ID NO: 43969 - protein, 10 aa, Artificial Sequence
  Peptide Derived from Human Papillomavirus
TASVGTPKPH

SEQ ID NO: 43970 - protein, 8 aa, Artificial Sequence
  Peptide Derived from Human Papillomavirus
TGILTVTY

SEQ ID NO: 43971 - protein, 8 aa, Artificial Sequence
  Peptide Derived from Human Papillomavirus
TSNNKRRK

SEQ ID NO: 43972 - protein, 8 aa, Artificial Sequence
  Peptide Derived from Human Papillomavirus
TTPIIHLK

SEQ ID NO: 43973 - protein, 11 aa, Artificial Sequence
  Peptide Derived from Human Papillomavirus
TTPIIHLKGDK

SEQ ID NO: 43974 - protein, 8 aa, Artificial Sequence
  Peptide Derived from Human Papillomavirus
TTYYVQFK

SEQ ID NO: 43975 - protein, 10 aa, Artificial Sequence
  Peptide Derived from Human Papillomavirus
TVHVYFDGNK

SEQ ID NO: 43976 - protein, 9 aa, Artificial Sequence
  Peptide Derived from Human Papillomavirus
TVSATQIVR

SEQ ID NO: 43977 - protein, 10 aa, Artificial Sequence
  Peptide Derived from Human Papillomavirus
TVTYNSEVQR

SEQ ID NO: 43978 - protein, 11 aa, Artificial Sequence
  Peptide Derived from Human Papillomavirus
VCSGNTTPIIH

SEQ ID NO: 43979 - protein, 8 aa, Artificial Sequence
  Peptide Derived from Human Papillomavirus
VSATQIVR

SEQ ID NO: 43980 - protein, 8 aa, Artificial Sequence
  Peptide Derived from Human Papillomavirus
VSYWGVYY

SEQ ID NO: 43981 - protein, 10 aa, Artificial Sequence
  Peptide Derived from Human Papillomavirus
VSYWGVYYIK

SEQ ID NO: 43982 - protein, 9 aa, Artificial Sequence
  Peptide Derived from Human Papillomavirus
VTYNSEVQR

SEQ ID NO: 43983 - protein, 9 aa, Artificial Sequence
  Peptide Derived from Human Papillomavirus
VVPPINISK

SEQ ID NO: 43984 - protein, 11 aa, Artificial Sequence
  Peptide Derived from Human Papillomavirus
VVPPINISKSK

SEQ ID NO: 43985 - protein, 8 aa, Artificial Sequence
  Peptide Derived from Human Papillomavirus
VVWDSIYY

SEQ ID NO: 43986 - protein, 10 aa, Artificial Sequence
  Peptide Derived from Human Papillomavirus
WDKTAACVSY

SEQ ID NO: 43987 - protein, 10 aa, Artificial Sequence
  Peptide Derived from Human Papillomavirus
WNTEPSQCFK

SEQ ID NO: 43988 - protein, 11 aa, Artificial Sequence
  Peptide Derived from Human Papillomavirus
WNTEPSQCFKK

SEQ ID NO: 43989 - protein, 11 aa, Artificial Sequence
  Peptide Derived from Human Papillomavirus
YGNSNTWEVQY

SEQ ID NO: 43990 - protein, 9 aa, Artificial Sequence
  Peptide Derived from Human Papillomavirus
YIKDGDTTY

SEQ ID NO: 43991 - protein, 10 aa, Artificial Sequence
  Peptide Derived from Human Papillomavirus
YIKDGDTTYY

SEQ ID NO: 43992 - protein, 10 aa, Artificial Sequence
  Peptide Derived from Human Papillomavirus
YITETGIWDK

SEQ ID NO: 43993 - protein, 9 aa, Artificial Sequence
  Peptide Derived from Human Papillomavirus
YSEISSTWH

SEQ ID NO: 43994 - protein, 10 aa, Artificial Sequence
  Peptide Derived from Human Papillomavirus
YVQFKSECEK

SEQ ID NO: 43995 - protein, 11 aa, Artificial Sequence
  Peptide Derived from Human Papillomavirus
YVQFKSECEKY

SEQ ID NO: 43996 - protein, 8 aa, Artificial Sequence
  Peptide Derived from Human Papillomavirus
YVVWDSIY

SEQ ID NO: 43997 - protein, 9 aa, Artificial Sequence
  Peptide Derived from Human Papillomavirus
YVVWDSIYY

SEQ ID NO: 43998 - protein, 10 aa, Artificial Sequence
  Peptide Derived from Human Papillomavirus
AACHKCIDFY

SEQ ID NO: 43999 - protein, 9 aa, Artificial Sequence
  Peptide Derived from Human Papillomavirus
ACHKCIDFY

SEQ ID NO: 44000 - protein, 11 aa, Artificial Sequence
  Peptide Derived from Human Papillomavirus
ACHKCIDFYSR

SEQ ID NO: 44001 - protein, 11 aa, Artificial Sequence
  Peptide Derived from Human Papillomavirus
ACVYCKATLER

SEQ ID NO: 44002 - protein, 9 aa, Artificial Sequence
  Peptide Derived from Human Papillomavirus
AFKDLFIVY

SEQ ID NO: 44003 - protein, 10 aa, Artificial Sequence
  Peptide Derived from Human Papillomavirus
AFKDLFIVYR

SEQ ID NO: 44004 - protein, 9 aa, Artificial Sequence
  Peptide Derived from Human Papillomavirus
ATLERTEVY

SEQ ID NO: 44005 - protein, 9 aa, Artificial Sequence
  Peptide Derived from Human Papillomavirus
CCDQARQER

SEQ ID NO: 44006 - protein, 11 aa, Artificial Sequence
  Peptide Derived from Human Papillomavirus
CCDQARQERLR

SEQ ID NO: 44007 - protein, 8 aa, Artificial Sequence
  Peptide Derived from Human Papillomavirus
CDQARQER

SEQ ID NO: 44008 - protein, 10 aa, Artificial Sequence
  Peptide Derived from Human Papillomavirus
CDQARQERLR

SEQ ID NO: 44009 - protein, 11 aa, Artificial Sequence
  Peptide Derived from Human Papillomavirus
CDQARQERLRR

SEQ ID NO: 44010 - protein, 8 aa, Artificial Sequence
  Peptide Derived from Human Papillomavirus
CIAYAACH

SEQ ID NO: 44011 - protein, 9 aa, Artificial Sequence
  Peptide Derived from Human Papillomavirus
CIAYAACHK

SEQ ID NO: 44012 - protein, 9 aa, Artificial Sequence
  Peptide Derived from Human Papillomavirus
CIDFYSRIR

SEQ ID NO: 44013 - protein, 9 aa, Artificial Sequence
  Peptide Derived from Human Papillomavirus
CNTCCDQAR

SEQ ID NO: 44014 - protein, 10 aa, Artificial Sequence
  Peptide Derived from Human Papillomavirus
CVYCKATLER

SEQ ID NO: 44015 - protein, 9 aa, Artificial Sequence
  Peptide Derived from Human Papillomavirus
DCIAYAACH

SEQ ID NO: 44016 - protein, 10 aa, Artificial Sequence
  Peptide Derived from Human Papillomavirus
DCIAYAACHK

SEQ ID NO: 44017 - protein, 8 aa, Artificial Sequence
  Peptide Derived from Human Papillomavirus
DDPTQRPY

SEQ ID NO: 44018 - protein, 9 aa, Artificial Sequence
  Peptide Derived from Human Papillomavirus
DDPTQRPYK

SEQ ID NO: 44019 - protein, 10 aa, Artificial Sequence
  Peptide Derived from Human Papillomavirus
DFYSRIRELR

SEQ ID NO: 44020 - protein, 11 aa, Artificial Sequence
  Peptide Derived from Human Papillomavirus
DFYSRIRELRY

SEQ ID NO: 44021 - protein, 8 aa, Artificial Sequence
  Peptide Derived from Human Papillomavirus
DVSIACVY

SEQ ID NO: 44022 - protein, 10 aa, Artificial Sequence
  Peptide Derived from Human Papillomavirus
DVSIACVYCK

SEQ ID NO: 44023 - protein, 10 aa, Artificial Sequence
  Peptide Derived from Human Papillomavirus
ELRYYSNSVY

SEQ ID NO: 44024 - protein, 8 aa, Artificial Sequence
  Peptide Derived from Human Papillomavirus
ELYNLLIR

SEQ ID NO: 44025 - protein, 11 aa, Artificial Sequence
  Peptide Derived from Human Papillomavirus
ELYNLLIRCLR

SEQ ID NO: 44026 - protein, 8 aa, Artificial Sequence
  Peptide Derived from Human Papillomavirus
EVYQFAFK

SEQ ID NO: 44027 - protein, 10 aa, Artificial Sequence
  Peptide Derived from Human Papillomavirus
FAFKDLFIVY

SEQ ID NO: 44028 - protein, 11 aa, Artificial Sequence
  Peptide Derived from Human Papillomavirus
FAFKDLFIVYR

SEQ ID NO: 44029 - protein, 9 aa, Artificial Sequence
  Peptide Derived from Human Papillomavirus
FDDPTQRPY

SEQ ID NO: 44030 - protein, 10 aa, Artificial Sequence
  Peptide Derived from Human Papillomavirus
FDDPTQRPYK

SEQ ID NO: 44031 - protein, 10 aa, Artificial Sequence
  Peptide Derived from Human Papillomavirus
FIVYRDCIAY

SEQ ID NO: 44032 - protein, 9 aa, Artificial Sequence
  Peptide Derived from Human Papillomavirus
HLKDKRRFH

SEQ ID NO: 44033 - protein, 8 aa, Artificial Sequence
  Peptide Derived from Human Papillomavirus
HSIAGQYR

SEQ ID NO: 44034 - protein, 8 aa, Artificial Sequence
  Peptide Derived from Human Papillomavirus
IAYAACHK

SEQ ID NO: 44035 - protein, 8 aa, Artificial Sequence
  Peptide Derived from Human Papillomavirus
IDFYSRIR

SEQ ID NO: 44036 - protein, 11 aa, Artificial Sequence
  Peptide Derived from Human Papillomavirus
IDFYSRIRELR

SEQ ID NO: 44037 - protein, 9 aa, Artificial Sequence
  Peptide Derived from Human Papillomavirus
IVYRDCIAY

SEQ ID NO: 44038 - protein, 10 aa, Artificial Sequence
  Peptide Derived from Human Papillomavirus
KATLERTEVY

SEQ ID NO: 44039 - protein, 8 aa, Artificial Sequence
  Peptide Derived from Human Papillomavirus
KCIDFYSR

SEQ ID NO: 44040 - protein, 10 aa, Artificial Sequence
  Peptide Derived from Human Papillomavirus
KCIDFYSRIR

SEQ ID NO: 44041 - protein, 8 aa, Artificial Sequence
  Peptide Derived from Human Papillomavirus
KDLFIVYR

SEQ ID NO: 44042 - protein, 8 aa, Artificial Sequence
  Peptide Derived from Human Papillomavirus
KITNTELY

SEQ ID NO: 44043 - protein, 11 aa, Artificial Sequence
  Peptide Derived from Human Papillomavirus
LFIVYRDCIAY

SEQ ID NO: 44044 - protein, 9 aa, Artificial Sequence
  Peptide Derived from Human Papillomavirus
LIRCLRCQK

SEQ ID NO: 44045 - protein, 10 aa, Artificial Sequence
  Peptide Derived from Human Papillomavirus
LLIRCLRCQK

SEQ ID NO: 44046 - protein, 8 aa, Artificial Sequence
  Peptide Derived from Human Papillomavirus
LNPAEKRR

SEQ ID NO: 44047 - protein, 9 aa, Artificial Sequence
  Peptide Derived from Human Papillomavirus
LNPAEKRRH

SEQ ID NO: 44048 - protein, 11 aa, Artificial Sequence
  Peptide Derived from Human Papillomavirus
LNPAEKRRHLK

SEQ ID NO: 44049 - protein, 10 aa, Artificial Sequence
  Peptide Derived from Human Papillomavirus
MARFDDPTQR

SEQ ID NO: 44050 - protein, 8 aa, Artificial Sequence
  Peptide Derived from Human Papillomavirus
NLLIRCLR

SEQ ID NO: 44051 - protein, 11 aa, Artificial Sequence
  Peptide Derived from Human Papillomavirus
NLLIRCLRCQK

SEQ ID NO: 44052 - protein, 10 aa, Artificial Sequence
  Peptide Derived from Human Papillomavirus
NSVYGETLEK

SEQ ID NO: 44053 - protein, 8 aa, Artificial Sequence
  Peptide Derived from Human Papillomavirus
NTCCDQAR

SEQ ID NO: 44054 - protein, 11 aa, Artificial Sequence
  Peptide Derived from Human Papillomavirus
NTCCDQARQER

SEQ ID NO: 44055 - protein, 10 aa, Artificial Sequence
  Peptide Derived from Human Papillomavirus
NTELYNLLIR

SEQ ID NO: 44056 - protein, 9 aa, Artificial Sequence
  Peptide Derived from Human Papillomavirus
PAEKRRHLK

SEQ ID NO: 44057 - protein, 11 aa, Artificial Sequence
  Peptide Derived from Human Papillomavirus
PAEKRRHLKDK

SEQ ID NO: 44058 - protein, 8 aa, Artificial Sequence
  Peptide Derived from Human Papillomavirus
PLNPAEKR

SEQ ID NO: 44059 - protein, 9 aa, Artificial Sequence
  Peptide Derived from Human Papillomavirus
PLNPAEKRR

SEQ ID NO: 44060 - protein, 10 aa, Artificial Sequence
  Peptide Derived from Human Papillomavirus
PLNPAEKRRH

SEQ ID NO: 44061 - protein, 8 aa, Artificial Sequence
  Peptide Derived from Human Papillomavirus
QARQERLR

SEQ ID NO: 44062 - protein, 9 aa, Artificial Sequence
  Peptide Derived from Human Papillomavirus
QARQERLRR

SEQ ID NO: 44063 - protein, 10 aa, Artificial Sequence
  Peptide Derived from Human Papillomavirus
QARQERLRRR

SEQ ID NO: 44064 - protein, 11 aa, Artificial Sequence
  Peptide Derived from Human Papillomavirus
QARQERLRRRR

SEQ ID NO: 44065 - protein, 10 aa, Artificial Sequence
  Peptide Derived from Human Papillomavirus
QCNTCCDQAR

SEQ ID NO: 44066 - protein, 9 aa, Artificial Sequence
  Peptide Derived from Human Papillomavirus
QDVSIACVY

SEQ ID NO: 44067 - protein, 11 aa, Artificial Sequence
  Peptide Derived from Human Papillomavirus
QDVSIACVYCK

SEQ ID NO: 44068 - protein, 11 aa, Artificial Sequence
  Peptide Derived from Human Papillomavirus
QFAFKDLFIVY

SEQ ID NO: 44069 - protein, 11 aa, Artificial Sequence
  Peptide Derived from Human Papillomavirus
RCQKPLNPAEK

SEQ ID NO: 44070 - protein, 10 aa, Artificial Sequence
  Peptide Derived from Human Papillomavirus
RDCIAYAACH

SEQ ID NO: 44071 - protein, 11 aa, Artificial Sequence
  Peptide Derived from Human Papillomavirus
RDCIAYAACHK

SEQ ID NO: 44072 - protein, 8 aa, Artificial Sequence
  Peptide Derived from Human Papillomavirus
RFDDPTQR

SEQ ID NO: 44073 - protein, 10 aa, Artificial Sequence
  Peptide Derived from Human Papillomavirus
RFDDPTQRPY

SEQ ID NO: 44074 - protein, 11 aa, Artificial Sequence
  Peptide Derived from Human Papillomavirus
RFDDPTQRPYK

SEQ ID NO: 44075 - protein, 9 aa, Artificial Sequence
  Peptide Derived from Human Papillomavirus
RFHSIAGQY

SEQ ID NO: 44076 - protein, 10 aa, Artificial Sequence
  Peptide Derived from Human Papillomavirus
RFHSIAGQYR

SEQ ID NO: 44077 - protein, 8 aa, Artificial Sequence
  Peptide Derived from Human Papillomavirus
RIRELRYY

SEQ ID NO: 44078 - protein, 10 aa, Artificial Sequence
  Peptide Derived from Human Papillomavirus
RTEVYQFAFK

SEQ ID NO: 44079 - protein, 8 aa, Artificial Sequence
  Peptide Derived from Human Papillomavirus
SIACVYCK

SEQ ID NO: 44080 - protein, 11 aa, Artificial Sequence
  Peptide Derived from Human Papillomavirus
SLQDVSIACVY

SEQ ID NO: 44081 - protein, 11 aa, Artificial Sequence
  Peptide Derived from Human Papillomavirus
SNSVYGETLEK

SEQ ID NO: 44082 - protein, 9 aa, Artificial Sequence
  Peptide Derived from Human Papillomavirus
SVYGETLEK

SEQ ID NO: 44083 - protein, 10 aa, Artificial Sequence
  Peptide Derived from Human Papillomavirus
TCCDQARQER

SEQ ID NO: 44084 - protein, 11 aa, Artificial Sequence
  Peptide Derived from Human Papillomavirus
TLEKITNTELY

SEQ ID NO: 44085 - protein, 8 aa, Artificial Sequence
  Peptide Derived from Human Papillomavirus
TLERTEVY

SEQ ID NO: 44086 - protein, 11 aa, Artificial Sequence
  Peptide Derived from Human Papillomavirus
TNTELYNLLIR

SEQ ID NO: 44087 - protein, 9 aa, Artificial Sequence
  Peptide Derived from Human Papillomavirus
VSIACVYCK

SEQ ID NO: 44088 - protein, 11 aa, Artificial Sequence
  Peptide Derived from Human Papillomavirus
YAACHKCIDFY

SEQ ID NO: 44089 - protein, 8 aa, Artificial Sequence
  Peptide Derived from Human Papillomavirus
YCKATLER

SEQ ID NO: 44090 - protein, 9 aa, Artificial Sequence
  Peptide Derived from Human Papillomavirus
YNLLIRCLR

SEQ ID NO: 44091 - protein, 8 aa, Artificial Sequence
  Peptide Derived from Human Papillomavirus
YSRIRELR

SEQ ID NO: 44092 - protein, 9 aa, Artificial Sequence
  Peptide Derived from Human Papillomavirus
YSRIRELRY

SEQ ID NO: 44093 - protein, 10 aa, Artificial Sequence
  Peptide Derived from Human Papillomavirus
YSRIRELRYY

SEQ ID NO: 44094 - protein, 9 aa, Artificial Sequence
  Peptide Derived from Human Papillomavirus
ATLQEIVLH

SEQ ID NO: 44095 - protein, 9 aa, Artificial Sequence
  Peptide Derived from Human Papillomavirus
CVCCKCDGR

SEQ ID NO: 44096 - protein, 11 aa, Artificial Sequence
  Peptide Derived from Human Papillomavirus
DGVSHAQLPAR

SEQ ID NO: 44097 - protein, 10 aa, Artificial Sequence
  Peptide Derived from Human Papillomavirus
ELDPVDLLCY

SEQ ID NO: 44098 - protein, 10 aa, Artificial Sequence
  Peptide Derived from Human Papillomavirus
ENDEADGVSH

SEQ ID NO: 44099 - protein, 8 aa, Artificial Sequence
  Peptide Derived from Human Papillomavirus
ESSADDLR

SEQ ID NO: 44100 - protein, 10 aa, Artificial Sequence
  Peptide Derived from Human Papillomavirus
GVSHAQLPAR

SEQ ID NO: 44101 - protein, 11 aa, Artificial Sequence
  Peptide Derived from Human Papillomavirus
GVSHAQLPARR

SEQ ID NO: 44102 - protein, 8 aa, Artificial Sequence
  Peptide Derived from Human Papillomavirus
HAQLPARR

SEQ ID NO: 44103 - protein, 11 aa, Artificial Sequence
  Peptide Derived from Human Papillomavirus
ILCVCCKCDGR

SEQ ID NO: 44104 - protein, 8 aa, Artificial Sequence
  Peptide Derived from Human Papillomavirus
KILCVCCK

SEQ ID NO: 44105 - protein, 10 aa, Artificial Sequence
  Peptide Derived from Human Papillomavirus
LCVCCKCDGR

SEQ ID NO: 44106 - protein, 9 aa, Artificial Sequence
  Peptide Derived from Human Papillomavirus
LDPVDLLCY

SEQ ID NO: 44107 - protein, 11 aa, Artificial Sequence
  Peptide Derived from Human Papillomavirus
LTVESSADDLR

SEQ ID NO: 44108 - protein, 9 aa, Artificial Sequence
  Peptide Derived from Human Papillomavirus
NDEADGVSH

SEQ ID NO: 44109 - protein, 9 aa, Artificial Sequence
  Peptide Derived from Human Papillomavirus
PARRAEPQR

SEQ ID NO: 44110 - protein, 10 aa, Artificial Sequence
  Peptide Derived from Human Papillomavirus
PARRAEPQRH

SEQ ID NO: 44111 - protein, 11 aa, Artificial Sequence
  Peptide Derived from Human Papillomavirus
PARRAEPQRHK

SEQ ID NO: 44112 - protein, 11 aa, Artificial Sequence
  Peptide Derived from Human Papillomavirus
QLPARRAEPQR

SEQ ID NO: 44113 - protein, 8 aa, Artificial Sequence
  Peptide Derived from Human Papillomavirus
RAEPQRHK

SEQ ID NO: 44114 - protein, 10 aa, Artificial Sequence
  Peptide Derived from Human Papillomavirus
RATLQEIVLH

SEQ ID NO: 44115 - protein, 8 aa, Artificial Sequence
  Peptide Derived from Human Papillomavirus
TLQEIVLH

SEQ ID NO: 44116 - protein, 10 aa, Artificial Sequence
  Peptide Derived from Human Papillomavirus
TVESSADDLR

SEQ ID NO: 44117 - protein, 8 aa, Artificial Sequence
  Peptide Derived from Human Papillomavirus
VCCKCDGR

SEQ ID NO: 44118 - protein, 9 aa, Artificial Sequence
  Peptide Derived from Human Papillomavirus
VSHAQLPAR

SEQ ID NO: 44119 - protein, 10 aa, Artificial Sequence
  Peptide Derived from Human Papillomavirus
VSHAQLPARR

SEQ ID NO: 44120 - protein, 9 aa, Artificial Sequence
  Peptide Derived from Human Papillomavirus
AASTSTASR

SEQ ID NO: 44121 - protein, 11 aa, Artificial Sequence
  Peptide Derived from Human Papillomavirus
AATAVITQDVR

SEQ ID NO: 44122 - protein, 9 aa, Artificial Sequence
  Peptide Derived from Human Papillomavirus
ACVGMEIGR

SEQ ID NO: 44123 - protein, 9 aa, Artificial Sequence
  Peptide Derived from Human Papillomavirus
AGNKQAVPK

SEQ ID NO: 44124 - protein, 8 aa, Artificial Sequence
  Peptide Derived from Human Papillomavirus
AIGEHWAK

SEQ ID NO: 44125 - protein, 11 aa, Artificial Sequence
  Peptide Derived from Human Papillomavirus
ALWRPSDSTVY

SEQ ID NO: 44126 - protein, 11 aa, Artificial Sequence
  Peptide Derived from Human Papillomavirus
AMDFSTLQDTK

SEQ ID NO: 44127 - protein, 9 aa, Artificial Sequence
  Peptide Derived from Human Papillomavirus
ASRPAKRVR

SEQ ID NO: 44128 - protein, 11 aa, Artificial Sequence
  Peptide Derived from Human Papillomavirus
ASRPAKRVRIR

SEQ ID NO: 44129 - protein, 11 aa, Artificial Sequence
  Peptide Derived from Human Papillomavirus
ASTQNPVPNTY

SEQ ID NO: 44130 - protein, 8 aa, Artificial Sequence
  Peptide Derived from Human Papillomavirus
ASTSTASR

SEQ ID NO: 44131 - protein, 11 aa, Artificial Sequence
  Peptide Derived from Human Papillomavirus
ASTSTASRPAK

SEQ ID NO: 44132 - protein, 10 aa, Artificial Sequence
  Peptide Derived from Human Papillomavirus
ATAVITQDVR

SEQ ID NO: 44133 - protein, 8 aa, Artificial Sequence
  Peptide Derived from Human Papillomavirus
AVITQDVR

SEQ ID NO: 44134 - protein, 8 aa, Artificial Sequence
  Peptide Derived from Human Papillomavirus
AVPKVSAY

SEQ ID NO: 44135 - protein, 10 aa, Artificial Sequence
  Peptide Derived from Human Papillomavirus
AVPKVSAYQY

SEQ ID NO: 44136 - protein, 11 aa, Artificial Sequence
  Peptide Derived from Human Papillomavirus
AVPKVSAYQYR

SEQ ID NO: 44137 - protein, 10 aa, Artificial Sequence
  Peptide Derived from Human Papillomavirus
CLRREQLFAR

SEQ ID NO: 44138 - protein, 11 aa, Artificial Sequence
  Peptide Derived from Human Papillomavirus
CLRREQLFARH

SEQ ID NO: 44139 - protein, 8 aa, Artificial Sequence
  Peptide Derived from Human Papillomavirus
CVGMEIGR

SEQ ID NO: 44140 - protein, 8 aa, Artificial Sequence
  Peptide Derived from Human Papillomavirus
CVPAIGEH

SEQ ID NO: 44141 - protein, 11 aa, Artificial Sequence
  Peptide Derived from Human Papillomavirus
CVPAIGEHWAK

SEQ ID NO: 44142 - protein, 8 aa, Artificial Sequence
  Peptide Derived from Human Papillomavirus
DCPPLELK

SEQ ID NO: 44143 - protein, 11 aa, Artificial Sequence
  Peptide Derived from Human Papillomavirus
DDYVSRTSIFY

SEQ ID NO: 44144 - protein, 9 aa, Artificial Sequence
  Peptide Derived from Human Papillomavirus
DFSTLQDTK

SEQ ID NO: 44145 - protein, 9 aa, Artificial Sequence
  Peptide Derived from Human Papillomavirus
DGDMVDTGY

SEQ ID NO: 44146 - protein, 8 aa, Artificial Sequence
  Peptide Derived from Human Papillomavirus
DICQSICK

SEQ ID NO: 44147 - protein, 9 aa, Artificial Sequence
  Peptide Derived from Human Papillomavirus
DICQSICKY

SEQ ID NO: 44148 - protein, 9 aa, Artificial Sequence
  Peptide Derived from Human Papillomavirus
DLDQYPLGR

SEQ ID NO: 44149 - protein, 10 aa, Artificial Sequence
  Peptide Derived from Human Papillomavirus
DLDQYPLGRK

SEQ ID NO: 44150 - protein, 8 aa, Artificial Sequence
  Peptide Derived from Human Papillomavirus
DNVSVDYK

SEQ ID NO: 44151 - protein, 8 aa, Artificial Sequence
  Peptide Derived from Human Papillomavirus
DSMFFCLR

SEQ ID NO: 44152 - protein, 9 aa, Artificial Sequence
  Peptide Derived from Human Papillomavirus
DSMFFCLRR

SEQ ID NO: 44153 - protein, 9 aa, Artificial Sequence
  Peptide Derived from Human Papillomavirus
DSQLFNKPY

SEQ ID NO: 44154 - protein, 11 aa, Artificial Sequence
  Peptide Derived from Human Papillomavirus
DSTIYNPETQR

SEQ ID NO: 44155 - protein, 11 aa, Artificial Sequence
  Peptide Derived from Human Papillomavirus
DTTPPEKQDPY

SEQ ID NO: 44156 - protein, 8 aa, Artificial Sequence
  Peptide Derived from Human Papillomavirus
DTVPTDLY

SEQ ID NO: 44157 - protein, 10 aa, Artificial Sequence
  Peptide Derived from Human Papillomavirus
DTVPTDLYIK

SEQ ID NO: 44158 - protein, 10 aa, Artificial Sequence
  Peptide Derived from Human Papillomavirus
DVRDNVSVDY

SEQ ID NO: 44159 - protein, 11 aa, Artificial Sequence
  Peptide Derived from Human Papillomavirus
DVRDNVSVDYK

SEQ ID NO: 44160 - protein, 10 aa, Artificial Sequence
  Peptide Derived from Human Papillomavirus
EDGDMVDTGY

SEQ ID NO: 44161 - protein, 8 aa, Artificial Sequence
  Peptide Derived from Human Papillomavirus
ETPGSCVY

SEQ ID NO: 44162 - protein, 8 aa, Artificial Sequence
  Peptide Derived from Human Papillomavirus
FARHFWNR

SEQ ID NO: 44163 - protein, 11 aa, Artificial Sequence
  Peptide Derived from Human Papillomavirus
FCLRREQLFAR

SEQ ID NO: 44164 - protein, 9 aa, Artificial Sequence
  Peptide Derived from Human Papillomavirus
FGLPDSTIY

SEQ ID NO: 44165 - protein, 8 aa, Artificial Sequence
  Peptide Derived from Human Papillomavirus
FLQMALWR

SEQ ID NO: 44166 - protein, 8 aa, Artificial Sequence
  Peptide Derived from Human Papillomavirus
FLVQAGLR

SEQ ID NO: 44167 - protein, 9 aa, Artificial Sequence
  Peptide Derived from Human Papillomavirus
FLVQAGLRR

SEQ ID NO: 44168 - protein, 10 aa, Artificial Sequence
  Peptide Derived from Human Papillomavirus
FLVQAGLRRR

SEQ ID NO: 44169 - protein, 8 aa, Artificial Sequence
  Peptide Derived from Human Papillomavirus
FNKPYWLH

SEQ ID NO: 44170 - protein, 9 aa, Artificial Sequence
  Peptide Derived from Human Papillomavirus
FNKPYWLHK

SEQ ID NO: 44171 - protein, 8 aa, Artificial Sequence
  Peptide Derived from Human Papillomavirus
FSSDLDQY

SEQ ID NO: 44172 - protein, 8 aa, Artificial Sequence
  Peptide Derived from Human Papillomavirus
FSTLQDTK

SEQ ID NO: 44173 - protein, 11 aa, Artificial Sequence
  Peptide Derived from Human Papillomavirus
FVQSVAVTCQK

SEQ ID NO: 44174 - protein, 9 aa, Artificial Sequence
  Peptide Derived from Human Papillomavirus
FVTVVDTTR

SEQ ID NO: 44175 - protein, 10 aa, Artificial Sequence
  Peptide Derived from Human Papillomavirus
GAGNKQAVPK

SEQ ID NO: 44176 - protein, 9 aa, Artificial Sequence
  Peptide Derived from Human Papillomavirus
GCVPAIGEH

SEQ ID NO: 44177 - protein, 9 aa, Artificial Sequence
  Peptide Derived from Human Papillomavirus
GDCPPLELK

SEQ ID NO: 44178 - protein, 8 aa, Artificial Sequence
  Peptide Derived from Human Papillomavirus
GDMVDTGY

SEQ ID NO: 44179 - protein, 9 aa, Artificial Sequence
  Peptide Derived from Human Papillomavirus
GDSMFFCLR

SEQ ID NO: 44180 - protein, 10 aa, Artificial Sequence
  Peptide Derived from Human Papillomavirus
GDSMFFCLRR

SEQ ID NO: 44181 - protein, 9 aa, Artificial Sequence
  Peptide Derived from Human Papillomavirus
GDTVPTDLY

SEQ ID NO: 44182 - protein, 11 aa, Artificial Sequence
  Peptide Derived from Human Papillomavirus
GDTVPTDLYIK

SEQ ID NO: 44183 - protein, 10 aa, Artificial Sequence
  Peptide Derived from Human Papillomavirus
GIGLSGHPFY

SEQ ID NO: 44184 - protein, 8 aa, Artificial Sequence
  Peptide Derived from Human Papillomavirus
GLPDSTIY

SEQ ID NO: 44185 - protein, 11 aa, Artificial Sequence
  Peptide Derived from Human Papillomavirus
GLRRRPTIGPR

SEQ ID NO: 44186 - protein, 8 aa, Artificial Sequence
  Peptide Derived from Human Papillomavirus
GLSGHPFY

SEQ ID NO: 44187 - protein, 10 aa, Artificial Sequence
  Peptide Derived from Human Papillomavirus
GLSGHPFYNK

SEQ ID NO: 44188 - protein, 8 aa, Artificial Sequence
  Peptide Derived from Human Papillomavirus
GNKQAVPK

SEQ ID NO: 44189 - protein, 8 aa, Artificial Sequence
  Peptide Derived from Human Papillomavirus
HGIIIFLK

SEQ ID NO: 44190 - protein, 8 aa, Artificial Sequence
  Peptide Derived from Human Papillomavirus
HNNGICWH

SEQ ID NO: 44191 - protein, 8 aa, Artificial Sequence
  Peptide Derived from Human Papillomavirus
ICQSICKY

SEQ ID NO: 44192 - protein, 11 aa, Artificial Sequence
  Peptide Derived from Human Papillomavirus
ICQSICKYPDY

SEQ ID NO: 44193 - protein, 9 aa, Artificial Sequence
  Peptide Derived from Human Papillomavirus
IFLQMALWR

SEQ ID NO: 44194 - protein, 9 aa, Artificial Sequence
  Peptide Derived from Human Papillomavirus
IFYHAGSSR

SEQ ID NO: 44195 - protein, 9 aa, Artificial Sequence
  Peptide Derived from Human Papillomavirus
IGLSGHPFY

SEQ ID NO: 44196 - protein, 11 aa, Artificial Sequence
  Peptide Derived from Human Papillomavirus
IGLSGHPFYNK

SEQ ID NO: 44197 - protein, 11 aa, Artificial Sequence
  Peptide Derived from Human Papillomavirus
ILGCVPAIGEH

SEQ ID NO: 44198 - protein, 10 aa, Artificial Sequence
  Peptide Derived from Human Papillomavirus
ITLTAEVMSY

SEQ ID NO: 44199 - protein, 11 aa, Artificial Sequence
  Peptide Derived from Human Papillomavirus
ITTSDSQLFNK

SEQ ID NO: 44200 - protein, 8 aa, Artificial Sequence
  Peptide Derived from Human Papillomavirus
KDTTPPEK

SEQ ID NO: 44201 - protein, 10 aa, Artificial Sequence
  Peptide Derived from Human Papillomavirus
KFGLPDSTIY

SEQ ID NO: 44202 - protein, 8 aa, Artificial Sequence
  Peptide Derived from Human Papillomavirus
KFKHYSRH

SEQ ID NO: 44203 - protein, 9 aa, Artificial Sequence
  Peptide Derived from Human Papillomavirus
KFLVQAGLR

SEQ ID NO: 44204 - protein, 10 aa, Artificial Sequence
  Peptide Derived from Human Papillomavirus
KFLVQAGLRR

SEQ ID NO: 44205 - protein, 11 aa, Artificial Sequence
  Peptide Derived from Human Papillomavirus
KFLVQAGLRRR

SEQ ID NO: 44206 - protein, 9 aa, Artificial Sequence
  Peptide Derived from Human Papillomavirus
KFSSDLDQY

SEQ ID NO: 44207 - protein, 8 aa, Artificial Sequence
  Peptide Derived from Human Papillomavirus
KFWTVDLK

SEQ ID NO: 44208 - protein, 10 aa, Artificial Sequence
  Peptide Derived from Human Papillomavirus
KFWTVDLKEK

SEQ ID NO: 44209 - protein, 8 aa, Artificial Sequence
  Peptide Derived from Human Papillomavirus
KGTSANMR

SEQ ID NO: 44210 - protein, 9 aa, Artificial Sequence
  Peptide Derived from Human Papillomavirus
KLDDTESAH

SEQ ID NO: 44211 - protein, 10 aa, Artificial Sequence
  Peptide Derived from Human Papillomavirus
KLKFWTVDLK

SEQ ID NO: 44212 - protein, 8 aa, Artificial Sequence
  Peptide Derived from Human Papillomavirus
KVSAYQYR

SEQ ID NO: 44213 - protein, 11 aa, Artificial Sequence
  Peptide Derived from Human Papillomavirus
KVSAYQYRVFR

SEQ ID NO: 44214 - protein, 8 aa, Artificial Sequence
  Peptide Derived from Human Papillomavirus
LDDTESAH

SEQ ID NO: 44215 - protein, 9 aa, Artificial Sequence
  Peptide Derived from Human Papillomavirus
LDICQSICK

SEQ ID NO: 44216 - protein, 10 aa, Artificial Sequence
  Peptide Derived from Human Papillomavirus
LDICQSICKY

SEQ ID NO: 44217 - protein, 8 aa, Artificial Sequence
  Peptide Derived from Human Papillomavirus
LDQYPLGR

SEQ ID NO: 44218 - protein, 9 aa, Artificial Sequence
  Peptide Derived from Human Papillomavirus
LDQYPLGRK

SEQ ID NO: 44219 - protein, 9 aa, Artificial Sequence
  Peptide Derived from Human Papillomavirus
LFARHFWNR

SEQ ID NO: 44220 - protein, 9 aa, Artificial Sequence
  Peptide Derived from Human Papillomavirus
LFNKPYWLH

SEQ ID NO: 44221 - protein, 10 aa, Artificial Sequence
  Peptide Derived from Human Papillomavirus
LFNKPYWLHK

SEQ ID NO: 44222 - protein, 10 aa, Artificial Sequence
  Peptide Derived from Human Papillomavirus
LFVTVVDTTR

SEQ ID NO: 44223 - protein, 10 aa, Artificial Sequence
  Peptide Derived from Human Papillomavirus
LGCVPAIGEH

SEQ ID NO: 44224 - protein, 8 aa, Artificial Sequence
  Peptide Derived from Human Papillomavirus
LGIGLSGH

SEQ ID NO: 44225 - protein, 11 aa, Artificial Sequence
  Peptide Derived from Human Papillomavirus
LGIGLSGHPFY

SEQ ID NO: 44226 - protein, 8 aa, Artificial Sequence
  Peptide Derived from Human Papillomavirus
LLTVGNPY

SEQ ID NO: 44227 - protein, 10 aa, Artificial Sequence
  Peptide Derived from Human Papillomavirus
LLTVGNPYFR

SEQ ID NO: 44228 - protein, 9 aa, Artificial Sequence
  Peptide Derived from Human Papillomavirus
LSGHPFYNK

SEQ ID NO: 44229 - protein, 8 aa, Artificial Sequence
  Peptide Derived from Human Papillomavirus
LTAEVMSY

SEQ ID NO: 44230 - protein, 10 aa, Artificial Sequence
  Peptide Derived from Human Papillomavirus
LTAEVMSYIH

SEQ ID NO: 44231 - protein, 9 aa, Artificial Sequence
  Peptide Derived from Human Papillomavirus
LTVGNPYFR

SEQ ID NO: 44232 - protein, 8 aa, Artificial Sequence
  Peptide Derived from Human Papillomavirus
LVQAGLRR

SEQ ID NO: 44233 - protein, 9 aa, Artificial Sequence
  Peptide Derived from Human Papillomavirus
LVQAGLRRR

SEQ ID NO: 44234 - protein, 9 aa, Artificial Sequence
  Peptide Derived from Human Papillomavirus
MAHNIIYGH

SEQ ID NO: 44235 - protein, 10 aa, Artificial Sequence
  Peptide Derived from Human Papillomavirus
MDFSTLQDTK

SEQ ID NO: 44236 - protein, 10 aa, Artificial Sequence
  Peptide Derived from Human Papillomavirus
MGDTVPTDLY

SEQ ID NO: 44237 - protein, 11 aa, Artificial Sequence
  Peptide Derived from Human Papillomavirus
NMRETPGSCVY

SEQ ID NO: 44238 - protein, 8 aa, Artificial Sequence
  Peptide Derived from Human Papillomavirus
NTDDYVSR

SEQ ID NO: 44239 - protein, 9 aa, Artificial Sequence
  Peptide Derived from Human Papillomavirus
NTYDPTKFK

SEQ ID NO: 44240 - protein, 10 aa, Artificial Sequence
  Peptide Derived from Human Papillomavirus
NTYDPTKFKH

SEQ ID NO: 44241 - protein, 11 aa, Artificial Sequence
  Peptide Derived from Human Papillomavirus
NTYDPTKFKHY

SEQ ID NO: 44242 - protein, 10 aa, Artificial Sequence
  Peptide Derived from Human Papillomavirus
PAASTSTASR

SEQ ID NO: 44243 - protein, 9 aa, Artificial Sequence
  Peptide Derived from Human Papillomavirus
PAIGEHWAK

SEQ ID NO: 44244 - protein, 8 aa, Artificial Sequence
  Peptide Derived from Human Papillomavirus
PAKRVRIR

SEQ ID NO: 44245 - protein, 10 aa, Artificial Sequence
  Peptide Derived from Human Papillomavirus
PAKRVRIRSK

SEQ ID NO: 44246 - protein, 11 aa, Artificial Sequence
  Peptide Derived from Human Papillomavirus
PAKRVRIRSKK

SEQ ID NO: 44247 - protein, 11 aa, Artificial Sequence
  Peptide Derived from Human Papillomavirus
PDYLQMSADPY

SEQ ID NO: 44248 - protein, 10 aa, Artificial Sequence
  Peptide Derived from Human Papillomavirus
PGDCPPLELK

SEQ ID NO: 44249 - protein, 10 aa, Artificial Sequence
  Peptide Derived from Human Papillomavirus
PIFLQMALWR

SEQ ID NO: 44250 - protein, 10 aa, Artificial Sequence
  Peptide Derived from Human Papillomavirus
PLDICQSICK

SEQ ID NO: 44251 - protein, 11 aa, Artificial Sequence
  Peptide Derived from Human Papillomavirus
PLDICQSICKY

SEQ ID NO: 44252 - protein, 9 aa, Artificial Sequence
  Peptide Derived from Human Papillomavirus
PLGIGLSGH

SEQ ID NO: 44253 - protein, 8 aa, Artificial Sequence
  Peptide Derived from Human Papillomavirus
PNTYDPTK

SEQ ID NO: 44254 - protein, 10 aa, Artificial Sequence
  Peptide Derived from Human Papillomavirus
PNTYDPTKFK

SEQ ID NO: 44255 - protein, 11 aa, Artificial Sequence
  Peptide Derived from Human Papillomavirus
PNTYDPTKFKH

SEQ ID NO: 44256 - protein, 8 aa, Artificial Sequence
  Peptide Derived from Human Papillomavirus
PTIGPRKR

SEQ ID NO: 44257 - protein, 9 aa, Artificial Sequence
  Peptide Derived from Human Papillomavirus
PTKFKHYSR

SEQ ID NO: 44258 - protein, 10 aa, Artificial Sequence
  Peptide Derived from Human Papillomavirus
PTKFKHYSRH

SEQ ID NO: 44259 - protein, 9 aa, Artificial Sequence
  Peptide Derived from Human Papillomavirus
PTTSLVDTY

SEQ ID NO: 44260 - protein, 10 aa, Artificial Sequence
  Peptide Derived from Human Papillomavirus
PTTSLVDTYR

SEQ ID NO: 44261 - protein, 10 aa, Artificial Sequence
  Peptide Derived from Human Papillomavirus
PVPNTYDPTK

SEQ ID NO: 44262 - protein, 9 aa, Artificial Sequence
  Peptide Derived from Human Papillomavirus
QAVPKVSAY

SEQ ID NO: 44263 - protein, 11 aa, Artificial Sequence
  Peptide Derived from Human Papillomavirus
QAVPKVSAYQY

SEQ ID NO: 44264 - protein, 8 aa, Artificial Sequence
  Peptide Derived from Human Papillomavirus
QDPYDKLK

SEQ ID NO: 44265 - protein, 11 aa, Artificial Sequence
  Peptide Derived from Human Papillomavirus
QDVRDNVSVDY

SEQ ID NO: 44266 - protein, 10 aa, Artificial Sequence
  Peptide Derived from Human Papillomavirus
QGHNNGICWH

SEQ ID NO: 44267 - protein, 10 aa, Artificial Sequence
  Peptide Derived from Human Papillomavirus
QLFARHFWNR

SEQ ID NO: 44268 - protein, 10 aa, Artificial Sequence
  Peptide Derived from Human Papillomavirus
QLFNKPYWLH

SEQ ID NO: 44269 - protein, 11 aa, Artificial Sequence
  Peptide Derived from Human Papillomavirus
QLFNKPYWLHK

SEQ ID NO: 44270 - protein, 11 aa, Artificial Sequence
  Peptide Derived from Human Papillomavirus
QLFVTVVDTTR

SEQ ID NO: 44271 - protein, 8 aa, Artificial Sequence
  Peptide Derived from Human Papillomavirus
QNPVPNTY

SEQ ID NO: 44272 - protein, 9 aa, Artificial Sequence
  Peptide Derived from Human Papillomavirus
QSICKYPDY

SEQ ID NO: 44273 - protein, 9 aa, Artificial Sequence
  Peptide Derived from Human Papillomavirus
QSVAVTCQK

SEQ ID NO: 44274 - protein, 8 aa, Artificial Sequence
  Peptide Derived from Human Papillomavirus
RDNVSVDY

SEQ ID NO: 44275 - protein, 9 aa, Artificial Sequence
  Peptide Derived from Human Papillomavirus
RDNVSVDYK

SEQ ID NO: 44276 - protein, 9 aa, Artificial Sequence
  Peptide Derived from Human Papillomavirus
RLLTVGNPY

SEQ ID NO: 44277 - protein, 11 aa, Artificial Sequence
  Peptide Derived from Human Papillomavirus
RLLTVGNPYFR

SEQ ID NO: 44278 - protein, 9 aa, Artificial Sequence
  Peptide Derived from Human Papillomavirus
RVALPDPNK

SEQ ID NO: 44279 - protein, 8 aa, Artificial Sequence
  Peptide Derived from Human Papillomavirus
RVRIRSKK

SEQ ID NO: 44280 - protein, 8 aa, Artificial Sequence
  Peptide Derived from Human Papillomavirus
RVVNTDDY

SEQ ID NO: 44281 - protein, 11 aa, Artificial Sequence
  Peptide Derived from Human Papillomavirus
RVVNTDDYVSR

SEQ ID NO: 44282 - protein, 10 aa, Artificial Sequence
  Peptide Derived from Human Papillomavirus
RVVPSGAGNK

SEQ ID NO: 44283 - protein, 9 aa, Artificial Sequence
  Peptide Derived from Human Papillomavirus
SAYQYRVFR

SEQ ID NO: 44284 - protein, 10 aa, Artificial Sequence
  Peptide Derived from Human Papillomavirus
SDLDQYPLGR

SEQ ID NO: 44285 - protein, 11 aa, Artificial Sequence
  Peptide Derived from Human Papillomavirus
SDLDQYPLGRK

SEQ ID NO: 44286 - protein, 8 aa, Artificial Sequence
  Peptide Derived from Human Papillomavirus
SDSQLFNK

SEQ ID NO: 44287 - protein, 10 aa, Artificial Sequence
  Peptide Derived from Human Papillomavirus
SDSQLFNKPY

SEQ ID NO: 44288 - protein, 11 aa, Artificial Sequence
  Peptide Derived from Human Papillomavirus
SGAGNKQAVPK

SEQ ID NO: 44289 - protein, 8 aa, Artificial Sequence
  Peptide Derived from Human Papillomavirus
SGHPFYNK

SEQ ID NO: 44290 - protein, 8 aa, Artificial Sequence
  Peptide Derived from Human Papillomavirus
SICKYPDY

SEQ ID NO: 44291 - protein, 10 aa, Artificial Sequence
  Peptide Derived from Human Papillomavirus
SIFYHAGSSR

SEQ ID NO: 44292 - protein, 8 aa, Artificial Sequence
  Peptide Derived from Human Papillomavirus
SMFFCLRR

SEQ ID NO: 44293 - protein, 11 aa, Artificial Sequence
  Peptide Derived from Human Papillomavirus
SSDLDQYPLGR

SEQ ID NO: 44294 - protein, 11 aa, Artificial Sequence
  Peptide Derived from Human Papillomavirus
SSRLLTVGNPY

SEQ ID NO: 44295 - protein, 8 aa, Artificial Sequence
  Peptide Derived from Human Papillomavirus
STASRPAK

SEQ ID NO: 44296 - protein, 9 aa, Artificial Sequence
  Peptide Derived from Human Papillomavirus
STASRPAKR

SEQ ID NO: 44297 - protein, 11 aa, Artificial Sequence
  Peptide Derived from Human Papillomavirus
STASRPAKRVR

SEQ ID NO: 44298 - protein, 10 aa, Artificial Sequence
  Peptide Derived from Human Papillomavirus
STIYNPETQR

SEQ ID NO: 44299 - protein, 10 aa, Artificial Sequence
  Peptide Derived from Human Papillomavirus
STQNPVPNTY

SEQ ID NO: 44300 - protein, 10 aa, Artificial Sequence
  Peptide Derived from Human Papillomavirus
STSTASRPAK

SEQ ID NO: 44301 - protein, 11 aa, Artificial Sequence
  Peptide Derived from Human Papillomavirus
STSTASRPAKR

SEQ ID NO: 44302 - protein, 11 aa, Artificial Sequence
  Peptide Derived from Human Papillomavirus
SVARVVNTDDY

SEQ ID NO: 44303 - protein, 8 aa, Artificial Sequence
  Peptide Derived from Human Papillomavirus
SVAVTCQK

SEQ ID NO: 44304 - protein, 9 aa, Artificial Sequence
  Peptide Derived from Human Papillomavirus
TAEVMSYIH

SEQ ID NO: 44305 - protein, 8 aa, Artificial Sequence
  Peptide Derived from Human Papillomavirus
TASRPAKR

SEQ ID NO: 44306 - protein, 10 aa, Artificial Sequence
  Peptide Derived from Human Papillomavirus
TASRPAKRVR

SEQ ID NO: 44307 - protein, 9 aa, Artificial Sequence
  Peptide Derived from Human Papillomavirus
TAVITQDVR

SEQ ID NO: 44308 - protein, 11 aa, Artificial Sequence
  Peptide Derived from Human Papillomavirus
TCQKDTTPPEK

SEQ ID NO: 44309 - protein, 11 aa, Artificial Sequence
  Peptide Derived from Human Papillomavirus
TITLTAEVMSY

SEQ ID NO: 44310 - protein, 9 aa, Artificial Sequence
  Peptide Derived from Human Papillomavirus
TIYNPETQR

SEQ ID NO: 44311 - protein, 9 aa, Artificial Sequence
  Peptide Derived from Human Papillomavirus
TLTAEVMSY

SEQ ID NO: 44312 - protein, 11 aa, Artificial Sequence
  Peptide Derived from Human Papillomavirus
TLTAEVMSYIH

SEQ ID NO: 44313 - protein, 9 aa, Artificial Sequence
  Peptide Derived from Human Papillomavirus
TSDSQLFNK

SEQ ID NO: 44314 - protein, 11 aa, Artificial Sequence
  Peptide Derived from Human Papillomavirus
TSDSQLFNKPY

SEQ ID NO: 44315 - protein, 11 aa, Artificial Sequence
  Peptide Derived from Human Papillomavirus
TSIFYHAGSSR

SEQ ID NO: 44316 - protein, 8 aa, Artificial Sequence
  Peptide Derived from Human Papillomavirus
TSLVDTYR

SEQ ID NO: 44317 - protein, 9 aa, Artificial Sequence
  Peptide Derived from Human Papillomavirus
TSTASRPAK

SEQ ID NO: 44318 - protein, 10 aa, Artificial Sequence
  Peptide Derived from Human Papillomavirus
TSTASRPAKR

SEQ ID NO: 44319 - protein, 10 aa, Artificial Sequence
  Peptide Derived from Human Papillomavirus
TTPPEKQDPY

SEQ ID NO: 44320 - protein, 10 aa, Artificial Sequence
  Peptide Derived from Human Papillomavirus
TTSDSQLFNK

SEQ ID NO: 44321 - protein, 8 aa, Artificial Sequence
  Peptide Derived from Human Papillomavirus
TTSLVDTY

SEQ ID NO: 44322 - protein, 9 aa, Artificial Sequence
  Peptide Derived from Human Papillomavirus
TTSLVDTYR

SEQ ID NO: 44323 - protein, 8 aa, Artificial Sequence
  Peptide Derived from Human Papillomavirus
TVGNPYFR

SEQ ID NO: 44324 - protein, 9 aa, Artificial Sequence
  Peptide Derived from Human Papillomavirus
TVPTDLYIK

SEQ ID NO: 44325 - protein, 11 aa, Artificial Sequence
  Peptide Derived from Human Papillomavirus
TVYLPPPSVAR

SEQ ID NO: 44326 - protein, 8 aa, Artificial Sequence
  Peptide Derived from Human Papillomavirus
VALPDPNK

SEQ ID NO: 44327 - protein, 10 aa, Artificial Sequence
  Peptide Derived from Human Papillomavirus
VARVVNTDDY

SEQ ID NO: 44328 - protein, 11 aa, Artificial Sequence
  Peptide Derived from Human Papillomavirus
VFRVALPDPNK

SEQ ID NO: 44329 - protein, 11 aa, Artificial Sequence
  Peptide Derived from Human Papillomavirus
VMGDTVPTDLY

SEQ ID NO: 44330 - protein, 9 aa, Artificial Sequence
  Peptide Derived from Human Papillomavirus
VNTDDYVSR

SEQ ID NO: 44331 - protein, 10 aa, Artificial Sequence
  Peptide Derived from Human Papillomavirus
VSAYQYRVFR

SEQ ID NO: 44332 - protein, 8 aa, Artificial Sequence
  Peptide Derived from Human Papillomavirus
VSRTSIFY

SEQ ID NO: 44333 - protein, 9 aa, Artificial Sequence
  Peptide Derived from Human Papillomavirus
VSRTSIFYH

SEQ ID NO: 44334 - protein, 8 aa, Artificial Sequence
  Peptide Derived from Human Papillomavirus
VTVVDTTR

SEQ ID NO: 44335 - protein, 10 aa, Artificial Sequence
  Peptide Derived from Human Papillomavirus
VVNTDDYVSR

SEQ ID NO: 44336 - protein, 9 aa, Artificial Sequence
  Peptide Derived from Human Papillomavirus
VVPSGAGNK

SEQ ID NO: 44337 - protein, 10 aa, Artificial Sequence
  Peptide Derived from Human Papillomavirus
WACVGMEIGR

SEQ ID NO: 44338 - protein, 8 aa, Artificial Sequence
  Peptide Derived from Human Papillomavirus
WAKGTLCK

SEQ ID NO: 44339 - protein, 8 aa, Artificial Sequence
  Peptide Derived from Human Papillomavirus
WLHKAQGH

SEQ ID NO: 44340 - protein, 8 aa, Artificial Sequence
  Peptide Derived from Human Papillomavirus
WTVDLKEK

SEQ ID NO: 44341 - protein, 8 aa, Artificial Sequence
  Peptide Derived from Human Papillomavirus
YDPTKFKH

SEQ ID NO: 44342 - protein, 9 aa, Artificial Sequence
  Peptide Derived from Human Papillomavirus
YDPTKFKHY

SEQ ID NO: 44343 - protein, 11 aa, Artificial Sequence
  Peptide Derived from Human Papillomavirus
YDPTKFKHYSR

SEQ ID NO: 44344 - protein, 10 aa, Artificial Sequence
  Peptide Derived from Human Papillomavirus
YGDSMFFCLR

SEQ ID NO: 44345 - protein, 11 aa, Artificial Sequence
  Peptide Derived from Human Papillomavirus
YGDSMFFCLRR

SEQ ID NO: 44346 - protein, 10 aa, Artificial Sequence
  Peptide Derived from Human Papillomavirus
YGHGIIIFLK

SEQ ID NO: 44347 - protein, 10 aa, Artificial Sequence
  Peptide Derived from Human Papillomavirus
YIKGTSANMR

SEQ ID NO: 44348 - protein, 9 aa, Artificial Sequence
  Peptide Derived from Human Papillomavirus
YLPPPSVAR

SEQ ID NO: 44349 - protein, 9 aa, Artificial Sequence
  Peptide Derived from Human Papillomavirus
YLQMSADPY

SEQ ID NO: 44350 - protein, 11 aa, Artificial Sequence
  Peptide Derived from Human Papillomavirus
YNKLDDTESAH

SEQ ID NO: 44351 - protein, 8 aa, Artificial Sequence
  Peptide Derived from Human Papillomavirus
YSRHVEEY

SEQ ID NO: 44352 - protein, 9 aa, Artificial Sequence
  Peptide Derived from Human Papillomavirus
YVSRTSIFY

SEQ ID NO: 44353 - protein, 10 aa, Artificial Sequence
  Peptide Derived from Human Papillomavirus
YVSRTSIFYH

SEQ ID NO: 44354 - protein, 10 aa, Artificial Sequence
  Peptide Derived from Human Papillomavirus
ALSSRRGTVR

SEQ ID NO: 44355 - protein, 8 aa, Artificial Sequence
  Peptide Derived from Human Papillomavirus
ASATDLYR

SEQ ID NO: 44356 - protein, 11 aa, Artificial Sequence
  Peptide Derived from Human Papillomavirus
ASATDLYRTCK

SEQ ID NO: 44357 - protein, 9 aa, Artificial Sequence
  Peptide Derived from Human Papillomavirus
ASTTPSTIH

SEQ ID NO: 44358 - protein, 10 aa, Artificial Sequence
  Peptide Derived from Human Papillomavirus
ASTTPSTIHK

SEQ ID NO: 44359 - protein, 10 aa, Artificial Sequence
  Peptide Derived from Human Papillomavirus
ASTTTYIGIH

SEQ ID NO: 44360 - protein, 9 aa, Artificial Sequence
  Peptide Derived from Human Papillomavirus
ATDLYRTCK

SEQ ID NO: 44361 - protein, 9 aa, Artificial Sequence
  Peptide Derived from Human Papillomavirus
ATMFTRSGK

SEQ ID NO: 44362 - protein, 11 aa, Artificial Sequence
  Peptide Derived from Human Papillomavirus
ATNDSDLFDVY

SEQ ID NO: 44363 - protein, 9 aa, Artificial Sequence
  Peptide Derived from Human Papillomavirus
DFMDIIRLH

SEQ ID NO: 44364 - protein, 10 aa, Artificial Sequence
  Peptide Derived from Human Papillomavirus
DFMDIIRLHR

SEQ ID NO: 44365 - protein, 9 aa, Artificial Sequence
  Peptide Derived from Human Papillomavirus
DSDFMDIIR

SEQ ID NO: 44366 - protein, 11 aa, Artificial Sequence
  Peptide Derived from Human Papillomavirus
DSDFMDIIRLH

SEQ ID NO: 44367 - protein, 8 aa, Artificial Sequence
  Peptide Derived from Human Papillomavirus
DSDLFDVY

SEQ ID NO: 44368 - protein, 8 aa, Artificial Sequence
  Peptide Derived from Human Papillomavirus
EGTTLADK

SEQ ID NO: 44369 - protein, 8 aa, Artificial Sequence
  Peptide Derived from Human Papillomavirus
FMDIIRLH

SEQ ID NO: 44370 - protein, 9 aa, Artificial Sequence
  Peptide Derived from Human Papillomavirus
FMDIIRLHR

SEQ ID NO: 44371 - protein, 11 aa, Artificial Sequence
  Peptide Derived from Human Papillomavirus
FTRSGKQIGGR

SEQ ID NO: 44372 - protein, 10 aa, Artificial Sequence
  Peptide Derived from Human Papillomavirus
FVGTPTSGSH

SEQ ID NO: 44373 - protein, 8 aa, Artificial Sequence
  Peptide Derived from Human Papillomavirus
GGRVHFYH

SEQ ID NO: 44374 - protein, 11 aa, Artificial Sequence
  Peptide Derived from Human Papillomavirus
GIGTGSGSGGR

SEQ ID NO: 44375 - protein, 8 aa, Artificial Sequence
  Peptide Derived from Human Papillomavirus
GIHGTQYY

SEQ ID NO: 44376 - protein, 8 aa, Artificial Sequence
  Peptide Derived from Human Papillomavirus
GSGGRTGY

SEQ ID NO: 44377 - protein, 10 aa, Artificial Sequence
  Peptide Derived from Human Papillomavirus
GSGSGGRTGY

SEQ ID NO: 44378 - protein, 10 aa, Artificial Sequence
  Peptide Derived from Human Papillomavirus
GTCPPDVINK

SEQ ID NO: 44379 - protein, 9 aa, Artificial Sequence
  Peptide Derived from Human Papillomavirus
GTGSGSGGR

SEQ ID NO: 44380 - protein, 8 aa, Artificial Sequence
  Peptide Derived from Human Papillomavirus
GTPTSGSH

SEQ ID NO: 44381 - protein, 10 aa, Artificial Sequence
  Peptide Derived from Human Papillomavirus
GTPTSGSHGY

SEQ ID NO: 44382 - protein, 10 aa, Artificial Sequence
  Peptide Derived from Human Papillomavirus
GTQYYLWPWY

SEQ ID NO: 44383 - protein, 11 aa, Artificial Sequence
  Peptide Derived from Human Papillomavirus
GTQYYLWPWYY

SEQ ID NO: 44384 - protein, 11 aa, Artificial Sequence
  Peptide Derived from Human Papillomavirus
GTVRFSRLGQR

SEQ ID NO: 44385 - protein, 11 aa, Artificial Sequence
  Peptide Derived from Human Papillomavirus
HGTQYYLWPWY

SEQ ID NO: 44386 - protein, 11 aa, Artificial Sequence
  Peptide Derived from Human Papillomavirus
IFVGTPTSGSH

SEQ ID NO: 44387 - protein, 8 aa, Artificial Sequence
  Peptide Derived from Human Papillomavirus
IGGRVHFY

SEQ ID NO: 44388 - protein, 9 aa, Artificial Sequence
  Peptide Derived from Human Papillomavirus
IGGRVHFYH

SEQ ID NO: 44389 - protein, 8 aa, Artificial Sequence
  Peptide Derived from Human Papillomavirus
IGIHGTQY

SEQ ID NO: 44390 - protein, 9 aa, Artificial Sequence
  Peptide Derived from Human Papillomavirus
IGIHGTQYY

SEQ ID NO: 44391 - protein, 10 aa, Artificial Sequence
  Peptide Derived from Human Papillomavirus
IGTGSGSGGR

SEQ ID NO: 44392 - protein, 10 aa, Artificial Sequence
  Peptide Derived from Human Papillomavirus
ISSTPLPTVR

SEQ ID NO: 44393 - protein, 11 aa, Artificial Sequence
  Peptide Derived from Human Papillomavirus
ISSTPLPTVRR

SEQ ID NO: 44394 - protein, 8 aa, Artificial Sequence
  Peptide Derived from Human Papillomavirus
KSFTYPKY

SEQ ID NO: 44395 - protein, 10 aa, Artificial Sequence
  Peptide Derived from Human Papillomavirus
KVEGTTLADK

SEQ ID NO: 44396 - protein, 10 aa, Artificial Sequence
  Peptide Derived from Human Papillomavirus
LGQRATMFTR

SEQ ID NO: 44397 - protein, 9 aa, Artificial Sequence
  Peptide Derived from Human Papillomavirus
LSSRRGTVR

SEQ ID NO: 44398 - protein, 11 aa, Artificial Sequence
  Peptide Derived from Human Papillomavirus
LTMPSTAASSY

SEQ ID NO: 44399 - protein, 10 aa, Artificial Sequence
  Peptide Derived from Human Papillomavirus
LTSAWDVPIY

SEQ ID NO: 44400 - protein, 9 aa, Artificial Sequence
  Peptide Derived from Human Papillomavirus
LVTFDNPAY

SEQ ID NO: 44401 - protein, 8 aa, Artificial Sequence
  Peptide Derived from Human Papillomavirus
MDIIRLHR

SEQ ID NO: 44402 - protein, 8 aa, Artificial Sequence
  Peptide Derived from Human Papillomavirus
MVSHRAAR

SEQ ID NO: 44403 - protein, 9 aa, Artificial Sequence
  Peptide Derived from Human Papillomavirus
MVSHRAARR

SEQ ID NO: 44404 - protein, 10 aa, Artificial Sequence
  Peptide Derived from Human Papillomavirus
MVSHRAARRK

SEQ ID NO: 44405 - protein, 11 aa, Artificial Sequence
  Peptide Derived from Human Papillomavirus
MVSHRAARRKR

SEQ ID NO: 44406 - protein, 11 aa, Artificial Sequence
  Peptide Derived from Human Papillomavirus
NASTTTYIGIH

SEQ ID NO: 44407 - protein, 9 aa, Artificial Sequence
  Peptide Derived from Human Papillomavirus
NDSDLFDVY

SEQ ID NO: 44408 - protein, 10 aa, Artificial Sequence
  Peptide Derived from Human Papillomavirus
NTVVDVGPTR

SEQ ID NO: 44409 - protein, 11 aa, Artificial Sequence
  Peptide Derived from Human Papillomavirus
PALSSRRGTVR

SEQ ID NO: 44410 - protein, 10 aa, Artificial Sequence
  Peptide Derived from Human Papillomavirus
PASTTPSTIH

SEQ ID NO: 44411 - protein, 11 aa, Artificial Sequence
  Peptide Derived from Human Papillomavirus
PASTTPSTIHK

SEQ ID NO: 44412 - protein, 8 aa, Artificial Sequence
  Peptide Derived from Human Papillomavirus
PDIILPSH

SEQ ID NO: 44413 - protein, 10 aa, Artificial Sequence
  Peptide Derived from Human Papillomavirus
PDSDFMDIIR

SEQ ID NO: 44414 - protein, 11 aa, Artificial Sequence
  Peptide Derived from Human Papillomavirus
PISSTPLPTVR

SEQ ID NO: 44415 - protein, 9 aa, Artificial Sequence
  Peptide Derived from Human Papillomavirus
PLPTVRRVR

SEQ ID NO: 44416 - protein, 11 aa, Artificial Sequence
  Peptide Derived from Human Papillomavirus
PLTSAWDVPIY

SEQ ID NO: 44417 - protein, 8 aa, Artificial Sequence
  Peptide Derived from Human Papillomavirus
PSTAASSY

SEQ ID NO: 44418 - protein, 10 aa, Artificial Sequence
  Peptide Derived from Human Papillomavirus
PSTIHKSFTY

SEQ ID NO: 44419 - protein, 9 aa, Artificial Sequence
  Peptide Derived from Human Papillomavirus
PTNASTTTY

SEQ ID NO: 44420 - protein, 8 aa, Artificial Sequence
  Peptide Derived from Human Papillomavirus
PTSGSHGY

SEQ ID NO: 44421 - protein, 10 aa, Artificial Sequence
  Peptide Derived from Human Papillomavirus
PTVRRVRGPR

SEQ ID NO: 44422 - protein, 9 aa, Artificial Sequence
  Peptide Derived from Human Papillomavirus
QIGGRVHFY

SEQ ID NO: 44423 - protein, 10 aa, Artificial Sequence
  Peptide Derived from Human Papillomavirus
QIGGRVHFYH

SEQ ID NO: 44424 - protein, 8 aa, Artificial Sequence
  Peptide Derived from Human Papillomavirus
RASATDLY

SEQ ID NO: 44425 - protein, 9 aa, Artificial Sequence
  Peptide Derived from Human Papillomavirus
RASATDLYR

SEQ ID NO: 44426 - protein, 10 aa, Artificial Sequence
  Peptide Derived from Human Papillomavirus
RATMFTRSGK

SEQ ID NO: 44427 - protein, 8 aa, Artificial Sequence
  Peptide Derived from Human Papillomavirus
RFSRLGQR

SEQ ID NO: 44428 - protein, 8 aa, Artificial Sequence
  Peptide Derived from Human Papillomavirus
RGPRLYSR

SEQ ID NO: 44429 - protein, 8 aa, Artificial Sequence
  Peptide Derived from Human Papillomavirus
RGTVRFSR

SEQ ID NO: 44430 - protein, 11 aa, Artificial Sequence
  Peptide Derived from Human Papillomavirus
RLGQRATMFTR

SEQ ID NO: 44431 - protein, 10 aa, Artificial Sequence
  Peptide Derived from Human Papillomavirus
RLHRPALSSR

SEQ ID NO: 44432 - protein, 11 aa, Artificial Sequence
  Peptide Derived from Human Papillomavirus
RLHRPALSSRR

SEQ ID NO: 44433 - protein, 11 aa, Artificial Sequence
  Peptide Derived from Human Papillomavirus
RLYSRANQQVR

SEQ ID NO: 44434 - protein, 9 aa, Artificial Sequence
  Peptide Derived from Human Papillomavirus
RSGKQIGGR

SEQ ID NO: 44435 - protein, 11 aa, Artificial Sequence
  Peptide Derived from Human Papillomavirus
RSGKQIGGRVH

SEQ ID NO: 44436 - protein, 10 aa, Artificial Sequence
  Peptide Derived from Human Papillomavirus
RTGYVPLGGR

SEQ ID NO: 44437 - protein, 8 aa, Artificial Sequence
  Peptide Derived from Human Papillomavirus
RVRGPRLY

SEQ ID NO: 44438 - protein, 10 aa, Artificial Sequence
  Peptide Derived from Human Papillomavirus
RVRGPRLYSR

SEQ ID NO: 44439 - protein, 10 aa, Artificial Sequence
  Peptide Derived from Human Papillomavirus
RVSTSQFLTH

SEQ ID NO: 44440 - protein, 10 aa, Artificial Sequence
  Peptide Derived from Human Papillomavirus
SATDLYRTCK

SEQ ID NO: 44441 - protein, 8 aa, Artificial Sequence
  Peptide Derived from Human Papillomavirus
SAWDVPIY

SEQ ID NO: 44442 - protein, 8 aa, Artificial Sequence
  Peptide Derived from Human Papillomavirus
SDFMDIIR

SEQ ID NO: 44443 - protein, 10 aa, Artificial Sequence
  Peptide Derived from Human Papillomavirus
SDFMDIIRLH

SEQ ID NO: 44444 - protein, 11 aa, Artificial Sequence
  Peptide Derived from Human Papillomavirus
SDFMDIIRLHR

SEQ ID NO: 44445 - protein, 8 aa, Artificial Sequence
  Peptide Derived from Human Papillomavirus
SGKQIGGR

SEQ ID NO: 44446 - protein, 10 aa, Artificial Sequence
  Peptide Derived from Human Papillomavirus
SGKQIGGRVH

SEQ ID NO: 44447 - protein, 9 aa, Artificial Sequence
  Peptide Derived from Human Papillomavirus
SGSGGRTGY

SEQ ID NO: 44448 - protein, 11 aa, Artificial Sequence
  Peptide Derived from Human Papillomavirus
SGTCPPDVINK

SEQ ID NO: 44449 - protein, 10 aa, Artificial Sequence
  Peptide Derived from Human Papillomavirus
SLVTFDNPAY

SEQ ID NO: 44450 - protein, 11 aa, Artificial Sequence
  Peptide Derived from Human Papillomavirus
SNTVVDVGPTR

SEQ ID NO: 44451 - protein, 11 aa, Artificial Sequence
  Peptide Derived from Human Papillomavirus
SSLVTFDNPAY

SEQ ID NO: 44452 - protein, 8 aa, Artificial Sequence
  Peptide Derived from Human Papillomavirus
SSRRGTVR

SEQ ID NO: 44453 - protein, 11 aa, Artificial Sequence
  Peptide Derived from Human Papillomavirus
SSRRGTVRFSR

SEQ ID NO: 44454 - protein, 9 aa, Artificial Sequence
  Peptide Derived from Human Papillomavirus
SSTPLPTVR

SEQ ID NO: 44455 - protein, 10 aa, Artificial Sequence
  Peptide Derived from Human Papillomavirus
SSTPLPTVRR

SEQ ID NO: 44456 - protein, 9 aa, Artificial Sequence
  Peptide Derived from Human Papillomavirus
STIHKSFTY

SEQ ID NO: 44457 - protein, 11 aa, Artificial Sequence
  Peptide Derived from Human Papillomavirus
STIHKSFTYPK

SEQ ID NO: 44458 - protein, 8 aa, Artificial Sequence
  Peptide Derived from Human Papillomavirus
STPLPTVR

SEQ ID NO: 44459 - protein, 9 aa, Artificial Sequence
  Peptide Derived from Human Papillomavirus
STPLPTVRR

SEQ ID NO: 44460 - protein, 11 aa, Artificial Sequence
  Peptide Derived from Human Papillomavirus
STPLPTVRRVR

SEQ ID NO: 44461 - protein, 8 aa, Artificial Sequence
  Peptide Derived from Human Papillomavirus
STSQFLTH

SEQ ID NO: 44462 - protein, 8 aa, Artificial Sequence
  Peptide Derived from Human Papillomavirus
STTPSTIH

SEQ ID NO: 44463 - protein, 9 aa, Artificial Sequence
  Peptide Derived from Human Papillomavirus
STTPSTIHK

SEQ ID NO: 44464 - protein, 9 aa, Artificial Sequence
  Peptide Derived from Human Papillomavirus
STTTYIGIH

SEQ ID NO: 44465 - protein, 9 aa, Artificial Sequence
  Peptide Derived from Human Papillomavirus
TCPPDVINK

SEQ ID NO: 44466 - protein, 8 aa, Artificial Sequence
  Peptide Derived from Human Papillomavirus
TDLYRTCK

SEQ ID NO: 44467 - protein, 10 aa, Artificial Sequence
  Peptide Derived from Human Papillomavirus
TGPDIILPSH

SEQ ID NO: 44468 - protein, 8 aa, Artificial Sequence
  Peptide Derived from Human Papillomavirus
TGSGSGGR

SEQ ID NO: 44469 - protein, 11 aa, Artificial Sequence
  Peptide Derived from Human Papillomavirus
TGSGSGGRTGY

SEQ ID NO: 44470 - protein, 9 aa, Artificial Sequence
  Peptide Derived from Human Papillomavirus
TGYVPLGGR

SEQ ID NO: 44471 - protein, 8 aa, Artificial Sequence
  Peptide Derived from Human Papillomavirus
TIHKSFTY

SEQ ID NO: 44472 - protein, 10 aa, Artificial Sequence
  Peptide Derived from Human Papillomavirus
TIHKSFTYPK

SEQ ID NO: 44473 - protein, 11 aa, Artificial Sequence
  Peptide Derived from Human Papillomavirus
TIHKSFTYPKY

SEQ ID NO: 44474 - protein, 8 aa, Artificial Sequence
  Peptide Derived from Human Papillomavirus
TMFTRSGK

SEQ ID NO: 44475 - protein, 10 aa, Artificial Sequence
  Peptide Derived from Human Papillomavirus
TMPSTAASSY

SEQ ID NO: 44476 - protein, 8 aa, Artificial Sequence
  Peptide Derived from Human Papillomavirus
TNASTTTY

SEQ ID NO: 44477 - protein, 10 aa, Artificial Sequence
  Peptide Derived from Human Papillomavirus
TNDSDLFDVY

SEQ ID NO: 44478 - protein, 9 aa, Artificial Sequence
  Peptide Derived from Human Papillomavirus
TSAWDVPIY

SEQ ID NO: 44479 - protein, 11 aa, Artificial Sequence
  Peptide Derived from Human Papillomavirus
TSPTNASTTTY

SEQ ID NO: 44480 - protein, 8 aa, Artificial Sequence
  Peptide Derived from Human Papillomavirus
TTPSTIHK

SEQ ID NO: 44481 - protein, 8 aa, Artificial Sequence
  Peptide Derived from Human Papillomavirus
TTTYIGIH

SEQ ID NO: 44482 - protein, 11 aa, Artificial Sequence
  Peptide Derived from Human Papillomavirus
TTYIGIHGTQY

SEQ ID NO: 44483 - protein, 10 aa, Artificial Sequence
  Peptide Derived from Human Papillomavirus
TVRFSRLGQR

SEQ ID NO: 44484 - protein, 9 aa, Artificial Sequence
  Peptide Derived from Human Papillomavirus
TVRRVRGPR

SEQ ID NO: 44485 - protein, 11 aa, Artificial Sequence
  Peptide Derived from Human Papillomavirus
TVRRVRGPRLY

SEQ ID NO: 44486 - protein, 9 aa, Artificial Sequence
  Peptide Derived from Human Papillomavirus
TVVDVGPTR

SEQ ID NO: 44487 - protein, 9 aa, Artificial Sequence
  Peptide Derived from Human Papillomavirus
VGTPTSGSH

SEQ ID NO: 44488 - protein, 11 aa, Artificial Sequence
  Peptide Derived from Human Papillomavirus
VGTPTSGSHGY

SEQ ID NO: 44489 - protein, 8 aa, Artificial Sequence
  Peptide Derived from Human Papillomavirus
VSHRAARR

SEQ ID NO: 44490 - protein, 9 aa, Artificial Sequence
  Peptide Derived from Human Papillomavirus
VSHRAARRK

SEQ ID NO: 44491 - protein, 10 aa, Artificial Sequence
  Peptide Derived from Human Papillomavirus
VSHRAARRKR

SEQ ID NO: 44492 - protein, 9 aa, Artificial Sequence
  Peptide Derived from Human Papillomavirus
VSTSQFLTH

SEQ ID NO: 44493 - protein, 8 aa, Artificial Sequence
  Peptide Derived from Human Papillomavirus
VTFDNPAY

SEQ ID NO: 44494 - protein, 8 aa, Artificial Sequence
  Peptide Derived from Human Papillomavirus
VVDVGPTR

SEQ ID NO: 44495 - protein, 8 aa, Artificial Sequence
  Peptide Derived from Human Papillomavirus
YFPKKRKR

SEQ ID NO: 44496 - protein, 11 aa, Artificial Sequence
  Peptide Derived from Human Papillomavirus
YFPKKRKRIPY

SEQ ID NO: 44497 - protein, 9 aa, Artificial Sequence
  Peptide Derived from Human Papillomavirus
YIGIHGTQY

SEQ ID NO: 44498 - protein, 10 aa, Artificial Sequence
  Peptide Derived from Human Papillomavirus
YIGIHGTQYY

SEQ ID NO: 44499 - protein, 8 aa, Artificial Sequence
  Peptide Derived from Human Papillomavirus
YLWPWYYY

SEQ ID NO: 44500 - protein, 11 aa, Artificial Sequence
  Peptide Derived from Human Papillomavirus
YLWPWYYYFPK

SEQ ID NO: 44501 - protein, 9 aa, Artificial Sequence
  Peptide Derived from Human Papillomavirus
YSRANQQVR

SEQ ID NO: 44502 - protein, 11 aa, Artificial Sequence
  Peptide Derived from Human Papillomavirus
YTGPDIILPSH

SEQ ID NO: 44503 - protein, 9 aa, Artificial Sequence
  Peptide Derived from Human Papillomavirus
AAVSHRPGK

SEQ ID NO: 44504 - protein, 10 aa, Artificial Sequence
  Peptide Derived from Human Papillomavirus
AAVSHRPGKR

SEQ ID NO: 44505 - protein, 10 aa, Artificial Sequence
  Peptide Derived from Human Papillomavirus
ALESLSTTIY

SEQ ID NO: 44506 - protein, 8 aa, Artificial Sequence
  Peptide Derived from Human Papillomavirus
AVSHRPGK

SEQ ID NO: 44507 - protein, 9 aa, Artificial Sequence
  Peptide Derived from Human Papillomavirus
AVSHRPGKR

SEQ ID NO: 44508 - protein, 11 aa, Artificial Sequence
  Peptide Derived from Human Papillomavirus
AVSHRPGKRPR

SEQ ID NO: 44509 - protein, 8 aa, Artificial Sequence
  Peptide Derived from Human Papillomavirus
CCRYRFQK

SEQ ID NO: 44510 - protein, 9 aa, Artificial Sequence
  Peptide Derived from Human Papillomavirus
CCRYRFQKY

SEQ ID NO: 44511 - protein, 10 aa, Artificial Sequence
  Peptide Derived from Human Papillomavirus
CCRYRFQKYK

SEQ ID NO: 44512 - protein, 8 aa, Artificial Sequence
  Peptide Derived from Human Papillomavirus
CFKKEGQH

SEQ ID NO: 44513 - protein, 8 aa, Artificial Sequence
  Peptide Derived from Human Papillomavirus
CLQVCKAK

SEQ ID NO: 44514 - protein, 8 aa, Artificial Sequence
  Peptide Derived from Human Papillomavirus
CMQYVAWK

SEQ ID NO: 44515 - protein, 9 aa, Artificial Sequence
  Peptide Derived from Human Papillomavirus
CMQYVAWKY

SEQ ID NO: 44516 - protein, 11 aa, Artificial Sequence
  Peptide Derived from Human Papillomavirus
CMQYVAWKYIY

SEQ ID NO: 44517 - protein, 10 aa, Artificial Sequence
  Peptide Derived from Human Papillomavirus
CSGVDYRGIY

SEQ ID NO: 44518 - protein, 11 aa, Artificial Sequence
  Peptide Derived from Human Papillomavirus
CSGVDYRGIYY

SEQ ID NO: 44519 - protein, 10 aa, Artificial Sequence
  Peptide Derived from Human Papillomavirus
DAAVSHRPGK

SEQ ID NO: 44520 - protein, 11 aa, Artificial Sequence
  Peptide Derived from Human Papillomavirus
DAAVSHRPGKR

SEQ ID NO: 44521 - protein, 8 aa, Artificial Sequence
  Peptide Derived from Human Papillomavirus
DFEQEAKK

SEQ ID NO: 44522 - protein, 10 aa, Artificial Sequence
  Peptide Derived from Human Papillomavirus
DGSKNNCMQY

SEQ ID NO: 44523 - protein, 8 aa, Artificial Sequence
  Peptide Derived from Human Papillomavirus
DNTDSRSR

SEQ ID NO: 44524 - protein, 9 aa, Artificial Sequence
  Peptide Derived from Human Papillomavirus
DSSRESHAK

SEQ ID NO: 44525 - protein, 8 aa, Artificial Sequence
  Peptide Derived from Human Papillomavirus
DSVSSTCR

SEQ ID NO: 44526 - protein, 9 aa, Artificial Sequence
  Peptide Derived from Human Papillomavirus
DSVSSTCRY

SEQ ID NO: 44527 - protein, 8 aa, Artificial Sequence
  Peptide Derived from Human Papillomavirus
DTDNTDSR

SEQ ID NO: 44528 - protein, 10 aa, Artificial Sequence
  Peptide Derived from Human Papillomavirus
DTDNTDSRSR

SEQ ID NO: 44529 - protein, 8 aa, Artificial Sequence
  Peptide Derived from Human Papillomavirus
EAKKFGCK

SEQ ID NO: 44530 - protein, 9 aa, Artificial Sequence
  Peptide Derived from Human Papillomavirus
EFDSSRESH

SEQ ID NO: 44531 - protein, 11 aa, Artificial Sequence
  Peptide Derived from Human Papillomavirus
EFDSSRESHAK

SEQ ID NO: 44532 - protein, 8 aa, Artificial Sequence
  Peptide Derived from Human Papillomavirus
ELWLTEPK

SEQ ID NO: 44533 - protein, 9 aa, Artificial Sequence
  Peptide Derived from Human Papillomavirus
ELWLTEPKK

SEQ ID NO: 44534 - protein, 8 aa, Artificial Sequence
  Peptide Derived from Human Papillomavirus
ESEFDSSR

SEQ ID NO: 44535 - protein, 11 aa, Artificial Sequence
  Peptide Derived from Human Papillomavirus
ESEFDSSRESH

SEQ ID NO: 44536 - protein, 10 aa, Artificial Sequence
  Peptide Derived from Human Papillomavirus
ESHAKCVTTH

SEQ ID NO: 44537 - protein, 8 aa, Artificial Sequence
  Peptide Derived from Human Papillomavirus
ESLSTTIY

SEQ ID NO: 44538 - protein, 10 aa, Artificial Sequence
  Peptide Derived from Human Papillomavirus
ETQRNSFLSH

SEQ ID NO: 44539 - protein, 9 aa, Artificial Sequence
  Peptide Derived from Human Papillomavirus
ETVNEYNTH

SEQ ID NO: 44540 - protein, 10 aa, Artificial Sequence
  Peptide Derived from Human Papillomavirus
ETVNEYNTHK

SEQ ID NO: 44541 - protein, 10 aa, Artificial Sequence
  Peptide Derived from Human Papillomavirus
EVHMENESIY

SEQ ID NO: 44542 - protein, 8 aa, Artificial Sequence
  Peptide Derived from Human Papillomavirus
EVWFDGSK

SEQ ID NO: 44543 - protein, 11 aa, Artificial Sequence
  Peptide Derived from Human Papillomavirus
FDGSKNNCMQY

SEQ ID NO: 44544 - protein, 8 aa, Artificial Sequence
  Peptide Derived from Human Papillomavirus
FDSSRESH

SEQ ID NO: 44545 - protein, 10 aa, Artificial Sequence
  Peptide Derived from Human Papillomavirus
FDSSRESHAK

SEQ ID NO: 44546 - protein, 10 aa, Artificial Sequence
  Peptide Derived from Human Papillomavirus
FGCKNIWEVH

SEQ ID NO: 44547 - protein, 11 aa, Artificial Sequence
  Peptide Derived from Human Papillomavirus
FLSHVKIPVVY

SEQ ID NO: 44548 - protein, 8 aa, Artificial Sequence
  Peptide Derived from Human Papillomavirus
FVDVTSTY

SEQ ID NO: 44549 - protein, 9 aa, Artificial Sequence
  Peptide Derived from Human Papillomavirus
FVDVTSTYH

SEQ ID NO: 44550 - protein, 9 aa, Artificial Sequence
  Peptide Derived from Human Papillomavirus
GCKNIWEVH

SEQ ID NO: 44551 - protein, 9 aa, Artificial Sequence
  Peptide Derived from Human Papillomavirus
GDKTTPVVH

SEQ ID NO: 44552 - protein, 11 aa, Artificial Sequence
  Peptide Derived from Human Papillomavirus
GDKTTPVVHLK

SEQ ID NO: 44553 - protein, 9 aa, Artificial Sequence
  Peptide Derived from Human Papillomavirus
GIYYVHDGH

SEQ ID NO: 44554 - protein, 10 aa, Artificial Sequence
  Peptide Derived from Human Papillomavirus
GIYYVHDGHK

SEQ ID NO: 44555 - protein, 9 aa, Artificial Sequence
  Peptide Derived from Human Papillomavirus
GNQDAAVSH

SEQ ID NO: 44556 - protein, 10 aa, Artificial Sequence
  Peptide Derived from Human Papillomavirus
GNQDAAVSHR

SEQ ID NO: 44557 - protein, 9 aa, Artificial Sequence
  Peptide Derived from Human Papillomavirus
GSKNNCMQY

SEQ ID NO: 44558 - protein, 8 aa, Artificial Sequence
  Peptide Derived from Human Papillomavirus
GVDYRGIY

SEQ ID NO: 44559 - protein, 9 aa, Artificial Sequence
  Peptide Derived from Human Papillomavirus
GVDYRGIYY

SEQ ID NO: 44560 - protein, 11 aa, Artificial Sequence
  Peptide Derived from Human Papillomavirus
GVDYRGIYYVH

SEQ ID NO: 44561 - protein, 8 aa, Artificial Sequence
  Peptide Derived from Human Papillomavirus
HAKCVTTH

SEQ ID NO: 44562 - protein, 10 aa, Artificial Sequence
  Peptide Derived from Human Papillomavirus
HAKCVTTHTH

SEQ ID NO: 44563 - protein, 8 aa, Artificial Sequence
  Peptide Derived from Human Papillomavirus
HDGHKTYY

SEQ ID NO: 44564 - protein, 10 aa, Artificial Sequence
  Peptide Derived from Human Papillomavirus
HIEVWFDGSK

SEQ ID NO: 44565 - protein, 11 aa, Artificial Sequence
  Peptide Derived from Human Papillomavirus
HISDTDNTDSR

SEQ ID NO: 44566 - protein, 8 aa, Artificial Sequence
  Peptide Derived from Human Papillomavirus
HLKGEPNR

SEQ ID NO: 44567 - protein, 10 aa, Artificial Sequence
  Peptide Derived from Human Papillomavirus
HLKGEPNRLK

SEQ ID NO: 44568 - protein, 8 aa, Artificial Sequence
  Peptide Derived from Human Papillomavirus
HMENESIY

SEQ ID NO: 44569 - protein, 8 aa, Artificial Sequence
  Peptide Derived from Human Papillomavirus
HVKIPVVY

SEQ ID NO: 44570 - protein, 9 aa, Artificial Sequence
  Peptide Derived from Human Papillomavirus
HVKIPVVYR

SEQ ID NO: 44571 - protein, 11 aa, Artificial Sequence
  Peptide Derived from Human Papillomavirus
IALESLSTTIY

SEQ ID NO: 44572 - protein, 9 aa, Artificial Sequence
  Peptide Derived from Human Papillomavirus
IIYKDETQR

SEQ ID NO: 44573 - protein, 10 aa, Artificial Sequence
  Peptide Derived from Human Papillomavirus
INNNNHPGDK

SEQ ID NO: 44574 - protein, 10 aa, Artificial Sequence
  Peptide Derived from Human Papillomavirus
ISDTDNTDSR

SEQ ID NO: 44575 - protein, 11 aa, Artificial Sequence
  Peptide Derived from Human Papillomavirus
ITIIYKDETQR

SEQ ID NO: 44576 - protein, 9 aa, Artificial Sequence
  Peptide Derived from Human Papillomavirus
KCCRYRFQK

SEQ ID NO: 44577 - protein, 10 aa, Artificial Sequence
  Peptide Derived from Human Papillomavirus
KCCRYRFQKY

SEQ ID NO: 44578 - protein, 11 aa, Artificial Sequence
  Peptide Derived from Human Papillomavirus
KCCRYRFQKYK

SEQ ID NO: 44579 - protein, 9 aa, Artificial Sequence
  Peptide Derived from Human Papillomavirus
KCFKKEGQH

SEQ ID NO: 44580 - protein, 8 aa, Artificial Sequence
  Peptide Derived from Human Papillomavirus
KCVTTHTH

SEQ ID NO: 44581 - protein, 11 aa, Artificial Sequence
  Peptide Derived from Human Papillomavirus
KFGCKNIWEVH

SEQ ID NO: 44582 - protein, 8 aa, Artificial Sequence
  Peptide Derived from Human Papillomavirus
KGEPNRLK

SEQ ID NO: 44583 - protein, 11 aa, Artificial Sequence
  Peptide Derived from Human Papillomavirus
KGEPNRLKCCR

SEQ ID NO: 44584 - protein, 11 aa, Artificial Sequence
  Peptide Derived from Human Papillomavirus
KNNCMQYVAWK

SEQ ID NO: 44585 - protein, 10 aa, Artificial Sequence
  Peptide Derived from Human Papillomavirus
KNYSIITIIY

SEQ ID NO: 44586 - protein, 11 aa, Artificial Sequence
  Peptide Derived from Human Papillomavirus
KNYSIITIIYK

SEQ ID NO: 44587 - protein, 11 aa, Artificial Sequence
  Peptide Derived from Human Papillomavirus
KTLFVDVTSTY

SEQ ID NO: 44588 - protein, 9 aa, Artificial Sequence
  Peptide Derived from Human Papillomavirus
KTTPVVHLK

SEQ ID NO: 44589 - protein, 8 aa, Artificial Sequence
  Peptide Derived from Human Papillomavirus
KVCSGVDY

SEQ ID NO: 44590 - protein, 9 aa, Artificial Sequence
  Peptide Derived from Human Papillomavirus
KVCSGVDYR

SEQ ID NO: 44591 - protein, 9 aa, Artificial Sequence
  Peptide Derived from Human Papillomavirus
LFVDVTSTY

SEQ ID NO: 44592 - protein, 10 aa, Artificial Sequence
  Peptide Derived from Human Papillomavirus
LFVDVTSTYH

SEQ ID NO: 44593 - protein, 10 aa, Artificial Sequence
  Peptide Derived from Human Papillomavirus
LSHVKIPVVY

SEQ ID NO: 44594 - protein, 11 aa, Artificial Sequence
  Peptide Derived from Human Papillomavirus
LSHVKIPVVYR

SEQ ID NO: 44595 - protein, 9 aa, Artificial Sequence
  Peptide Derived from Human Papillomavirus
LTEPKKCFK

SEQ ID NO: 44596 - protein, 10 aa, Artificial Sequence
  Peptide Derived from Human Papillomavirus
LTEPKKCFKK

SEQ ID NO: 44597 - protein, 9 aa, Artificial Sequence
  Peptide Derived from Human Papillomavirus
MVPCLQVCK

SEQ ID NO: 44598 - protein, 11 aa, Artificial Sequence
  Peptide Derived from Human Papillomavirus
MVPCLQVCKAK

SEQ ID NO: 44599 - protein, 9 aa, Artificial Sequence
  Peptide Derived from Human Papillomavirus
NCMQYVAWK

SEQ ID NO: 44600 - protein, 10 aa, Artificial Sequence
  Peptide Derived from Human Papillomavirus
NCMQYVAWKY

SEQ ID NO: 44601 - protein, 8 aa, Artificial Sequence
  Peptide Derived from Human Papillomavirus
NGDCGWQK

SEQ ID NO: 44602 - protein, 10 aa, Artificial Sequence
  Peptide Derived from Human Papillomavirus
NNCMQYVAWK

SEQ ID NO: 44603 - protein, 11 aa, Artificial Sequence
  Peptide Derived from Human Papillomavirus
NNCMQYVAWKY

SEQ ID NO: 44604 - protein, 8 aa, Artificial Sequence
  Peptide Derived from Human Papillomavirus
NNEEWTLR

SEQ ID NO: 44605 - protein, 8 aa, Artificial Sequence
  Peptide Derived from Human Papillomavirus
NNNHPGDK

SEQ ID NO: 44606 - protein, 9 aa, Artificial Sequence
  Peptide Derived from Human Papillomavirus
NNNNHPGDK

SEQ ID NO: 44607 - protein, 8 aa, Artificial Sequence
  Peptide Derived from Human Papillomavirus
NSFLSHVK

SEQ ID NO: 44608 - protein, 11 aa, Artificial Sequence
  Peptide Derived from Human Papillomavirus
NVSPVETVNEY

SEQ ID NO: 44609 - protein, 9 aa, Artificial Sequence
  Peptide Derived from Human Papillomavirus
PCLQVCKAK

SEQ ID NO: 44610 - protein, 9 aa, Artificial Sequence
  Peptide Derived from Human Papillomavirus
PDSVSSTCR

SEQ ID NO: 44611 - protein, 10 aa, Artificial Sequence
  Peptide Derived from Human Papillomavirus
PDSVSSTCRY

SEQ ID NO: 44612 - protein, 10 aa, Artificial Sequence
  Peptide Derived from Human Papillomavirus
PGDKTTPVVH

SEQ ID NO: 44613 - protein, 8 aa, Artificial Sequence
  Peptide Derived from Human Papillomavirus
PGKRPRLR

SEQ ID NO: 44614 - protein, 8 aa, Artificial Sequence
  Peptide Derived from Human Papillomavirus
PNRLKCCR

SEQ ID NO: 44615 - protein, 9 aa, Artificial Sequence
  Peptide Derived from Human Papillomavirus
PNRLKCCRY

SEQ ID NO: 44616 - protein, 10 aa, Artificial Sequence
  Peptide Derived from Human Papillomavirus
PNRLKCCRYR

SEQ ID NO: 44617 - protein, 8 aa, Artificial Sequence
  Peptide Derived from Human Papillomavirus
PVETVNEY

SEQ ID NO: 44618 - protein, 11 aa, Artificial Sequence
  Peptide Derived from Human Papillomavirus
PVETVNEYNTH

SEQ ID NO: 44619 - protein, 11 aa, Artificial Sequence
  Peptide Derived from Human Papillomavirus
PVVHLKGEPNR

SEQ ID NO: 44620 - protein, 10 aa, Artificial Sequence
  Peptide Derived from Human Papillomavirus
PVVYRLVWDK

SEQ ID NO: 44621 - protein, 8 aa, Artificial Sequence
  Peptide Derived from Human Papillomavirus
QDAAVSHR

SEQ ID NO: 44622 - protein, 11 aa, Artificial Sequence
  Peptide Derived from Human Papillomavirus
QDAAVSHRPGK

SEQ ID NO: 44623 - protein, 10 aa, Artificial Sequence
  Peptide Derived from Human Papillomavirus
RGIYYVHDGH

SEQ ID NO: 44624 - protein, 11 aa, Artificial Sequence
  Peptide Derived from Human Papillomavirus
RGIYYVHDGHK

SEQ ID NO: 44625 - protein, 8 aa, Artificial Sequence
  Peptide Derived from Human Papillomavirus
RLKCCRYR

SEQ ID NO: 44626 - protein, 11 aa, Artificial Sequence
  Peptide Derived from Human Papillomavirus
RLKCCRYRFQK

SEQ ID NO: 44627 - protein, 11 aa, Artificial Sequence
  Peptide Derived from Human Papillomavirus
RLRESEFDSSR

SEQ ID NO: 44628 - protein, 9 aa, Artificial Sequence
  Peptide Derived from Human Papillomavirus
RNSFLSHVK

SEQ ID NO: 44629 - protein, 8 aa, Artificial Sequence
  Peptide Derived from Human Papillomavirus
RSINNNNH

SEQ ID NO: 44630 - protein, 10 aa, Artificial Sequence
  Peptide Derived from Human Papillomavirus
RSRSINNNNH

SEQ ID NO: 44631 - protein, 9 aa, Artificial Sequence
  Peptide Derived from Human Papillomavirus
SDTDNTDSR

SEQ ID NO: 44632 - protein, 11 aa, Artificial Sequence
  Peptide Derived from Human Papillomavirus
SDTDNTDSRSR

SEQ ID NO: 44633 - protein, 9 aa, Artificial Sequence
  Peptide Derived from Human Papillomavirus
SGVDYRGIY

SEQ ID NO: 44634 - protein, 10 aa, Artificial Sequence
  Peptide Derived from Human Papillomavirus
SGVDYRGIYY

SEQ ID NO: 44635 - protein, 8 aa, Artificial Sequence
  Peptide Derived from Human Papillomavirus
SIITIIYK

SEQ ID NO: 44636 - protein, 11 aa, Artificial Sequence
  Peptide Derived from Human Papillomavirus
SINNNNHPGDK

SEQ ID NO: 44637 - protein, 8 aa, Artificial Sequence
  Peptide Derived from Human Papillomavirus
SSRESHAK

SEQ ID NO: 44638 - protein, 11 aa, Artificial Sequence
  Peptide Derived from Human Papillomavirus
STYHWTSTDNK

SEQ ID NO: 44639 - protein, 11 aa, Artificial Sequence
  Peptide Derived from Human Papillomavirus
SVGNQDAAVSH

SEQ ID NO: 44640 - protein, 8 aa, Artificial Sequence
  Peptide Derived from Human Papillomavirus
SVSSTCRY

SEQ ID NO: 44641 - protein, 11 aa, Artificial Sequence
  Peptide Derived from Human Papillomavirus
TCEELWLTEPK

SEQ ID NO: 44642 - protein, 8 aa, Artificial Sequence
  Peptide Derived from Human Papillomavirus
TDFEQEAK

SEQ ID NO: 44643 - protein, 9 aa, Artificial Sequence
  Peptide Derived from Human Papillomavirus
TDFEQEAKK

SEQ ID NO: 44644 - protein, 9 aa, Artificial Sequence
  Peptide Derived from Human Papillomavirus
TDNTDSRSR

SEQ ID NO: 44645 - protein, 10 aa, Artificial Sequence
  Peptide Derived from Human Papillomavirus
TIIYKDETQR

SEQ ID NO: 44646 - protein, 11 aa, Artificial Sequence
  Peptide Derived from Human Papillomavirus
TIYNNEEWTLR

SEQ ID NO: 44647 - protein, 10 aa, Artificial Sequence
  Peptide Derived from Human Papillomavirus
TLFVDVTSTY

SEQ ID NO: 44648 - protein, 11 aa, Artificial Sequence
  Peptide Derived from Human Papillomavirus
TLFVDVTSTYH

SEQ ID NO: 44649 - protein, 8 aa, Artificial Sequence
  Peptide Derived from Human Papillomavirus
TSTDNKNY

SEQ ID NO: 44650 - protein, 8 aa, Artificial Sequence
  Peptide Derived from Human Papillomavirus
TTPVVHLK

SEQ ID NO: 44651 - protein, 8 aa, Artificial Sequence
  Peptide Derived from Human Papillomavirus
TVNEYNTH

SEQ ID NO: 44652 - protein, 9 aa, Artificial Sequence
  Peptide Derived from Human Papillomavirus
TVNEYNTHK

SEQ ID NO: 44653 - protein, 8 aa, Artificial Sequence
  Peptide Derived from Human Papillomavirus
VAWKYIYY

SEQ ID NO: 44654 - protein, 8 aa, Artificial Sequence
  Peptide Derived from Human Papillomavirus
VCSGVDYR

SEQ ID NO: 44655 - protein, 11 aa, Artificial Sequence
  Peptide Derived from Human Papillomavirus
VCSGVDYRGIY

SEQ ID NO: 44656 - protein, 8 aa, Artificial Sequence
  Peptide Derived from Human Papillomavirus
VDVTSTYH

SEQ ID NO: 44657 - protein, 8 aa, Artificial Sequence
  Peptide Derived from Human Papillomavirus
VDYRGIYY

SEQ ID NO: 44658 - protein, 10 aa, Artificial Sequence
  Peptide Derived from Human Papillomavirus
VDYRGIYYVH

SEQ ID NO: 44659 - protein, 10 aa, Artificial Sequence
  Peptide Derived from Human Papillomavirus
VGNQDAAVSH

SEQ ID NO: 44660 - protein, 11 aa, Artificial Sequence
  Peptide Derived from Human Papillomavirus
VGNQDAAVSHR

SEQ ID NO: 44661 - protein, 8 aa, Artificial Sequence
  Peptide Derived from Human Papillomavirus
VNEYNTHK

SEQ ID NO: 44662 - protein, 8 aa, Artificial Sequence
  Peptide Derived from Human Papillomavirus
VSHRPGKR

SEQ ID NO: 44663 - protein, 10 aa, Artificial Sequence
  Peptide Derived from Human Papillomavirus
VSHRPGKRPR

SEQ ID NO: 44664 - protein, 10 aa, Artificial Sequence
  Peptide Derived from Human Papillomavirus
VSPVETVNEY

SEQ ID NO: 44665 - protein, 10 aa, Artificial Sequence
  Peptide Derived from Human Papillomavirus
VVHLKGEPNR

SEQ ID NO: 44666 - protein, 9 aa, Artificial Sequence
  Peptide Derived from Human Papillomavirus
VVYRLVWDK

SEQ ID NO: 44667 - protein, 10 aa, Artificial Sequence
  Peptide Derived from Human Papillomavirus
WLTEPKKCFK

SEQ ID NO: 44668 - protein, 11 aa, Artificial Sequence
  Peptide Derived from Human Papillomavirus
WLTEPKKCFKK

SEQ ID NO: 44669 - protein, 9 aa, Artificial Sequence
  Peptide Derived from Human Papillomavirus
WTSTDNKNY

SEQ ID NO: 44670 - protein, 11 aa, Artificial Sequence
  Peptide Derived from Human Papillomavirus
YCPDSVSSTCR

SEQ ID NO: 44671 - protein, 9 aa, Artificial Sequence
  Peptide Derived from Human Papillomavirus
YNGDCGWQK

SEQ ID NO: 44672 - protein, 9 aa, Artificial Sequence
  Peptide Derived from Human Papillomavirus
YNNEEWTLR

SEQ ID NO: 44673 - protein, 8 aa, Artificial Sequence
  Peptide Derived from Human Papillomavirus
YSIITIIY

SEQ ID NO: 44674 - protein, 9 aa, Artificial Sequence
  Peptide Derived from Human Papillomavirus
YSIITIIYK

SEQ ID NO: 44675 - protein, 9 aa, Artificial Sequence
  Peptide Derived from Human Papillomavirus
YTDFEQEAK

SEQ ID NO: 44676 - protein, 10 aa, Artificial Sequence
  Peptide Derived from Human Papillomavirus
YTDFEQEAKK

SEQ ID NO: 44677 - protein, 8 aa, Artificial Sequence
  Peptide Derived from Human Papillomavirus
YVAWKYIY

SEQ ID NO: 44678 - protein, 9 aa, Artificial Sequence
  Peptide Derived from Human Papillomavirus
YVAWKYIYY

SEQ ID NO: 44679 - protein, 9 aa, Artificial Sequence
  Peptide Derived from Human Papillomavirus
YVHDGHKTY

SEQ ID NO: 44680 - protein, 10 aa, Artificial Sequence
  Peptide Derived from Human Papillomavirus
YVHDGHKTYY

SEQ ID NO: 44681 - protein, 9 aa, Artificial Sequence
  Peptide Derived from Human Papillomavirus
ACTELKLVY

SEQ ID NO: 44682 - protein, 10 aa, Artificial Sequence
  Peptide Derived from Human Papillomavirus
ACTELKLVYR

SEQ ID NO: 44683 - protein, 8 aa, Artificial Sequence
  Peptide Derived from Human Papillomavirus
ATLESITK

SEQ ID NO: 44684 - protein, 9 aa, Artificial Sequence
  Peptide Derived from Human Papillomavirus
ATLESITKK

SEQ ID NO: 44685 - protein, 10 aa, Artificial Sequence
  Peptide Derived from Human Papillomavirus
AVCRVCLLFY

SEQ ID NO: 44686 - protein, 8 aa, Artificial Sequence
  Peptide Derived from Human Papillomavirus
CDLLIRCY

SEQ ID NO: 44687 - protein, 9 aa, Artificial Sequence
  Peptide Derived from Human Papillomavirus
CDLLIRCYR

SEQ ID NO: 44688 - protein, 8 aa, Artificial Sequence
  Peptide Derived from Human Papillomavirus
CDRKRRFH

SEQ ID NO: 44689 - protein, 10 aa, Artificial Sequence
  Peptide Derived from Human Papillomavirus
CLGCWRQTSR

SEQ ID NO: 44690 - protein, 9 aa, Artificial Sequence
  Peptide Derived from Human Papillomavirus
CLLFYSKVR

SEQ ID NO: 44691 - protein, 10 aa, Artificial Sequence
  Peptide Derived from Human Papillomavirus
CLLFYSKVRK

SEQ ID NO: 44692 - protein, 11 aa, Artificial Sequence
  Peptide Derived from Human Papillomavirus
CLLFYSKVRKY

SEQ ID NO: 44693 - protein, 8 aa, Artificial Sequence
  Peptide Derived from Human Papillomavirus
CTELKLVY

SEQ ID NO: 44694 - protein, 9 aa, Artificial Sequence
  Peptide Derived from Human Papillomavirus
CTELKLVYR

SEQ ID NO: 44695 - protein, 10 aa, Artificial Sequence
  Peptide Derived from Human Papillomavirus
CVYCKKELTR

SEQ ID NO: 44696 - protein, 9 aa, Artificial Sequence
  Peptide Derived from Human Papillomavirus
DDFPYAVCR

SEQ ID NO: 44697 - protein, 8 aa, Artificial Sequence
  Peptide Derived from Human Papillomavirus
DFPYAVCR

SEQ ID NO: 44698 - protein, 8 aa, Artificial Sequence
  Peptide Derived from Human Papillomavirus
DLLIRCYR

SEQ ID NO: 44699 - protein, 8 aa, Artificial Sequence
  Peptide Derived from Human Papillomavirus
DLRLSCVY

SEQ ID NO: 44700 - protein, 10 aa, Artificial Sequence
  Peptide Derived from Human Papillomavirus
DLRLSCVYCK

SEQ ID NO: 44701 - protein, 11 aa, Artificial Sequence
  Peptide Derived from Human Papillomavirus
DLRLSCVYCKK

SEQ ID NO: 44702 - protein, 8 aa, Artificial Sequence
  Peptide Derived from Human Papillomavirus
EIPLIDLR

SEQ ID NO: 44703 - protein, 8 aa, Artificial Sequence
  Peptide Derived from Human Papillomavirus
ELTRAEVY

SEQ ID NO: 44704 - protein, 11 aa, Artificial Sequence
  Peptide Derived from Human Papillomavirus
EVLEIPLIDLR

SEQ ID NO: 44705 - protein, 11 aa, Artificial Sequence
  Peptide Derived from Human Papillomavirus
EVYNFACTELK

SEQ ID NO: 44706 - protein, 10 aa, Artificial Sequence
  Peptide Derived from Human Papillomavirus
FACTELKLVY

SEQ ID NO: 44707 - protein, 11 aa, Artificial Sequence
  Peptide Derived from Human Papillomavirus
FACTELKLVYR

SEQ ID NO: 44708 - protein, 9 aa, Artificial Sequence
  Peptide Derived from Human Papillomavirus
FNNPQERPR

SEQ ID NO: 44709 - protein, 9 aa, Artificial Sequence
  Peptide Derived from Human Papillomavirus
GATLESITK

SEQ ID NO: 44710 - protein, 10 aa, Artificial Sequence
  Peptide Derived from Human Papillomavirus
GATLESITKK

SEQ ID NO: 44711 - protein, 8 aa, Artificial Sequence
  Peptide Derived from Human Papillomavirus
GCWRQTSR

SEQ ID NO: 44712 - protein, 11 aa, Artificial Sequence
  Peptide Derived from Human Papillomavirus
GCWRQTSREPR

SEQ ID NO: 44713 - protein, 8 aa, Artificial Sequence
  Peptide Derived from Human Papillomavirus
GSCLGCWR

SEQ ID NO: 44714 - protein, 9 aa, Artificial Sequence
  Peptide Derived from Human Papillomavirus
HCDRKRRFH

SEQ ID NO: 44715 - protein, 9 aa, Artificial Sequence
  Peptide Derived from Human Papillomavirus
IDLRLSCVY

SEQ ID NO: 44716 - protein, 11 aa, Artificial Sequence
  Peptide Derived from Human Papillomavirus
IDLRLSCVYCK

SEQ ID NO: 44717 - protein, 10 aa, Artificial Sequence
  Peptide Derived from Human Papillomavirus
KLVYRDDFPY

SEQ ID NO: 44718 - protein, 8 aa, Artificial Sequence
  Peptide Derived from Human Papillomavirus
KVRKYRYY

SEQ ID NO: 44719 - protein, 10 aa, Artificial Sequence
  Peptide Derived from Human Papillomavirus
KVRKYRYYDY

SEQ ID NO: 44720 - protein, 9 aa, Artificial Sequence
  Peptide Derived from Human Papillomavirus
LCDLLIRCY

SEQ ID NO: 44721 - protein, 10 aa, Artificial Sequence
  Peptide Derived from Human Papillomavirus
LCDLLIRCYR

SEQ ID NO: 44722 - protein, 8 aa, Artificial Sequence
  Peptide Derived from Human Papillomavirus
LFYSKVRK

SEQ ID NO: 44723 - protein, 9 aa, Artificial Sequence
  Peptide Derived from Human Papillomavirus
LFYSKVRKY

SEQ ID NO: 44724 - protein, 10 aa, Artificial Sequence
  Peptide Derived from Human Papillomavirus
LFYSKVRKYR

SEQ ID NO: 44725 - protein, 11 aa, Artificial Sequence
  Peptide Derived from Human Papillomavirus
LFYSKVRKYRY

SEQ ID NO: 44726 - protein, 9 aa, Artificial Sequence
  Peptide Derived from Human Papillomavirus
LGCWRQTSR

SEQ ID NO: 44727 - protein, 10 aa, Artificial Sequence
  Peptide Derived from Human Papillomavirus
LIDLRLSCVY

SEQ ID NO: 44728 - protein, 8 aa, Artificial Sequence
  Peptide Derived from Human Papillomavirus
LLFYSKVR

SEQ ID NO: 44729 - protein, 9 aa, Artificial Sequence
  Peptide Derived from Human Papillomavirus
LLFYSKVRK

SEQ ID NO: 44730 - protein, 10 aa, Artificial Sequence
  Peptide Derived from Human Papillomavirus
LLFYSKVRKY

SEQ ID NO: 44731 - protein, 11 aa, Artificial Sequence
  Peptide Derived from Human Papillomavirus
LLFYSKVRKYR

SEQ ID NO: 44732 - protein, 8 aa, Artificial Sequence
  Peptide Derived from Human Papillomavirus
LSCVYCKK

SEQ ID NO: 44733 - protein, 9 aa, Artificial Sequence
  Peptide Derived from Human Papillomavirus
LTPEEKQLH

SEQ ID NO: 44734 - protein, 9 aa, Artificial Sequence
  Peptide Derived from Human Papillomavirus
LVYRDDFPY

SEQ ID NO: 44735 - protein, 8 aa, Artificial Sequence
  Peptide Derived from Human Papillomavirus
NFACTELK

SEQ ID NO: 44736 - protein, 11 aa, Artificial Sequence
  Peptide Derived from Human Papillomavirus
NFACTELKLVY

SEQ ID NO: 44737 - protein, 8 aa, Artificial Sequence
  Peptide Derived from Human Papillomavirus
NNPQERPR

SEQ ID NO: 44738 - protein, 11 aa, Artificial Sequence
  Peptide Derived from Human Papillomavirus
NNPQERPRSLH

SEQ ID NO: 44739 - protein, 11 aa, Artificial Sequence
  Peptide Derived from Human Papillomavirus
PLIDLRLSCVY

SEQ ID NO: 44740 - protein, 10 aa, Artificial Sequence
  Peptide Derived from Human Papillomavirus
PLTPEEKQLH

SEQ ID NO: 44741 - protein, 8 aa, Artificial Sequence
  Peptide Derived from Human Papillomavirus
QFNNPQER

SEQ ID NO: 44742 - protein, 10 aa, Artificial Sequence
  Peptide Derived from Human Papillomavirus
QFNNPQERPR

SEQ ID NO: 44743 - protein, 8 aa, Artificial Sequence
  Peptide Derived from Human Papillomavirus
QLCDLLIR

SEQ ID NO: 44744 - protein, 10 aa, Artificial Sequence
  Peptide Derived from Human Papillomavirus
QLCDLLIRCY

SEQ ID NO: 44745 - protein, 11 aa, Artificial Sequence
  Peptide Derived from Human Papillomavirus
QLCDLLIRCYR

SEQ ID NO: 44746 - protein, 8 aa, Artificial Sequence
  Peptide Derived from Human Papillomavirus
QLHCDRKR

SEQ ID NO: 44747 - protein, 9 aa, Artificial Sequence
  Peptide Derived from Human Papillomavirus
QLHCDRKRR

SEQ ID NO: 44748 - protein, 11 aa, Artificial Sequence
  Peptide Derived from Human Papillomavirus
QLHCDRKRRFH

SEQ ID NO: 44749 - protein, 9 aa, Artificial Sequence
  Peptide Derived from Human Papillomavirus
QSPLTPEEK

SEQ ID NO: 44750 - protein, 11 aa, Artificial Sequence
  Peptide Derived from Human Papillomavirus
RCQSPLTPEEK

SEQ ID NO: 44751 - protein, 10 aa, Artificial Sequence
  Peptide Derived from Human Papillomavirus
RDDFPYAVCR

SEQ ID NO: 44752 - protein, 8 aa, Artificial Sequence
  Peptide Derived from Human Papillomavirus
RLSCVYCK

SEQ ID NO: 44753 - protein, 9 aa, Artificial Sequence
  Peptide Derived from Human Papillomavirus
RLSCVYCKK

SEQ ID NO: 44754 - protein, 9 aa, Artificial Sequence
  Peptide Derived from Human Papillomavirus
RVCLLFYSK

SEQ ID NO: 44755 - protein, 11 aa, Artificial Sequence
  Peptide Derived from Human Papillomavirus
RVCLLFYSKVR

SEQ ID NO: 44756 - protein, 11 aa, Artificial Sequence
  Peptide Derived from Human Papillomavirus
SCLGCWRQTSR

SEQ ID NO: 44757 - protein, 11 aa, Artificial Sequence
  Peptide Derived from Human Papillomavirus
SCVYCKKELTR

SEQ ID NO: 44758 - protein, 9 aa, Artificial Sequence
  Peptide Derived from Human Papillomavirus
TGSCLGCWR

SEQ ID NO: 44759 - protein, 8 aa, Artificial Sequence
  Peptide Derived from Human Papillomavirus
TLESITKK

SEQ ID NO: 44760 - protein, 8 aa, Artificial Sequence
  Peptide Derived from Human Papillomavirus
VCLLFYSK

SEQ ID NO: 44761 - protein, 10 aa, Artificial Sequence
  Peptide Derived from Human Papillomavirus
VCLLFYSKVR

SEQ ID NO: 44762 - protein, 11 aa, Artificial Sequence
  Peptide Derived from Human Papillomavirus
VCLLFYSKVRK

SEQ ID NO: 44763 - protein, 9 aa, Artificial Sequence
  Peptide Derived from Human Papillomavirus
VCRVCLLFY

SEQ ID NO: 44764 - protein, 11 aa, Artificial Sequence
  Peptide Derived from Human Papillomavirus
VCRVCLLFYSK

SEQ ID NO: 44765 - protein, 10 aa, Artificial Sequence
  Peptide Derived from Human Papillomavirus
VLEIPLIDLR

SEQ ID NO: 44766 - protein, 10 aa, Artificial Sequence
  Peptide Derived from Human Papillomavirus
WTGSCLGCWR

SEQ ID NO: 44767 - protein, 11 aa, Artificial Sequence
  Peptide Derived from Human Papillomavirus
YAVCRVCLLFY

SEQ ID NO: 44768 - protein, 8 aa, Artificial Sequence
  Peptide Derived from Human Papillomavirus
YCKKELTR

SEQ ID NO: 44769 - protein, 10 aa, Artificial Sequence
  Peptide Derived from Human Papillomavirus
YGATLESITK

SEQ ID NO: 44770 - protein, 11 aa, Artificial Sequence
  Peptide Derived from Human Papillomavirus
YGATLESITKK

SEQ ID NO: 44771 - protein, 9 aa, Artificial Sequence
  Peptide Derived from Human Papillomavirus
YNFACTELK

SEQ ID NO: 44772 - protein, 8 aa, Artificial Sequence
  Peptide Derived from Human Papillomavirus
YSKVRKYR

SEQ ID NO: 44773 - protein, 9 aa, Artificial Sequence
  Peptide Derived from Human Papillomavirus
YSKVRKYRY

SEQ ID NO: 44774 - protein, 10 aa, Artificial Sequence
  Peptide Derived from Human Papillomavirus
YSKVRKYRYY

SEQ ID NO: 44775 - protein, 10 aa, Artificial Sequence
  Peptide Derived from Human Papillomavirus
DIQSTKEDLR

SEQ ID NO: 44776 - protein, 10 aa, Artificial Sequence
  Peptide Derived from Human Papillomavirus
EDEDEDEVDH

SEQ ID NO: 44777 - protein, 8 aa, Artificial Sequence
  Peptide Derived from Human Papillomavirus
EDEDEVDH

SEQ ID NO: 44778 - protein, 10 aa, Artificial Sequence
  Peptide Derived from Human Papillomavirus
EDEVDHLQER

SEQ ID NO: 44779 - protein, 8 aa, Artificial Sequence
  Peptide Derived from Human Papillomavirus
EVDHLQER

SEQ ID NO: 44780 - protein, 11 aa, Artificial Sequence
  Peptide Derived from Human Papillomavirus
FVVQLDIQSTK

SEQ ID NO: 44781 - protein, 10 aa, Artificial Sequence
  Peptide Derived from Human Papillomavirus
HLQERPQQAR

SEQ ID NO: 44782 - protein, 8 aa, Artificial Sequence
  Peptide Derived from Human Papillomavirus
HVPCCECK

SEQ ID NO: 44783 - protein, 11 aa, Artificial Sequence
  Peptide Derived from Human Papillomavirus
LDIQSTKEDLR

SEQ ID NO: 44784 - protein, 10 aa, Artificial Sequence
  Peptide Derived from Human Papillomavirus
LIHVPCCECK

SEQ ID NO: 44785 - protein, 8 aa, Artificial Sequence
  Peptide Derived from Human Papillomavirus
QAKQHTCY

SEQ ID NO: 44786 - protein, 11 aa, Artificial Sequence
  Peptide Derived from Human Papillomavirus
QAKQHTCYLIH

SEQ ID NO: 44787 - protein, 8 aa, Artificial Sequence
  Peptide Derived from Human Papillomavirus
QARQAKQH

SEQ ID NO: 44788 - protein, 11 aa, Artificial Sequence
  Peptide Derived from Human Papillomavirus
QARQAKQHTCY

SEQ ID NO: 44789 - protein, 8 aa, Artificial Sequence
  Peptide Derived from Human Papillomavirus
QLDIQSTK

SEQ ID NO: 44790 - protein, 8 aa, Artificial Sequence
  Peptide Derived from Human Papillomavirus
QSTKEDLR

SEQ ID NO: 44791 - protein, 10 aa, Artificial Sequence
  Peptide Derived from Human Papillomavirus
VVQLDIQSTK

SEQ ID NO: 44792 - protein, 11 aa, Artificial Sequence
  Peptide Derived from Human Papillomavirus
YLIHVPCCECK

SEQ ID NO: 44793 - protein, 9 aa, Artificial Sequence
  Peptide Derived from Human Papillomavirus
ACVGLEVGR

SEQ ID NO: 44794 - protein, 11 aa, Artificial Sequence
  Peptide Derived from Human Papillomavirus
ADAYGDSMWFY

SEQ ID NO: 44795 - protein, 11 aa, Artificial Sequence
  Peptide Derived from Human Papillomavirus
AGLSGHPLFNR

SEQ ID NO: 44796 - protein, 11 aa, Artificial Sequence
  Peptide Derived from Human Papillomavirus
AGSSRLLAVGH

SEQ ID NO: 44797 - protein, 11 aa, Artificial Sequence
  Peptide Derived from Human Papillomavirus
AMDFKVLQESK

SEQ ID NO: 44798 - protein, 8 aa, Artificial Sequence
  Peptide Derived from Human Papillomavirus
AMGEHWTK

SEQ ID NO: 44799 - protein, 10 aa, Artificial Sequence
  Peptide Derived from Human Papillomavirus
ANNNVIEDSR

SEQ ID NO: 44800 - protein, 8 aa, Artificial Sequence
  Peptide Derived from Human Papillomavirus
ATDSYVKR

SEQ ID NO: 44801 - protein, 8 aa, Artificial Sequence
  Peptide Derived from Human Papillomavirus
ATEQLSKY

SEQ ID NO: 44802 - protein, 11 aa, Artificial Sequence
  Peptide Derived from Human Papillomavirus
ATEQLSKYDAR

SEQ ID NO: 44803 - protein, 8 aa, Artificial Sequence
  Peptide Derived from Human Papillomavirus
ATSLEDKY

SEQ ID NO: 44804 - protein, 9 aa, Artificial Sequence
  Peptide Derived from Human Papillomavirus
ATSLEDKYR

SEQ ID NO: 44805 - protein, 10 aa, Artificial Sequence
  Peptide Derived from Human Papillomavirus
ATSLEDKYRY

SEQ ID NO: 44806 - protein, 9 aa, Artificial Sequence
  Peptide Derived from Human Papillomavirus
ATWRPSENK

SEQ ID NO: 44807 - protein, 11 aa, Artificial Sequence
  Peptide Derived from Human Papillomavirus
ATWRPSENKVY

SEQ ID NO: 44808 - protein, 8 aa, Artificial Sequence
  Peptide Derived from Human Papillomavirus
AVATSKKR

SEQ ID NO: 44809 - protein, 11 aa, Artificial Sequence
  Peptide Derived from Human Papillomavirus
AVGHPYYSVTK

SEQ ID NO: 44810 - protein, 8 aa, Artificial Sequence
  Peptide Derived from Human Papillomavirus
CTPAMGEH

SEQ ID NO: 44811 - protein, 11 aa, Artificial Sequence
  Peptide Derived from Human Papillomavirus
CTPAMGEHWTK

SEQ ID NO: 44812 - protein, 8 aa, Artificial Sequence
  Peptide Derived from Human Papillomavirus
CVGLEVGR

SEQ ID NO: 44813 - protein, 8 aa, Artificial Sequence
  Peptide Derived from Human Papillomavirus
DARKINQY

SEQ ID NO: 44814 - protein, 10 aa, Artificial Sequence
  Peptide Derived from Human Papillomavirus
DARKINQYLR

SEQ ID NO: 44815 - protein, 11 aa, Artificial Sequence
  Peptide Derived from Human Papillomavirus
DARKINQYLRH

SEQ ID NO: 44816 - protein, 10 aa, Artificial Sequence
  Peptide Derived from Human Papillomavirus
DAYGDSMWFY

SEQ ID NO: 44817 - protein, 9 aa, Artificial Sequence
  Peptide Derived from Human Papillomavirus
DFKVLQESK

SEQ ID NO: 44818 - protein, 8 aa, Artificial Sequence
  Peptide Derived from Human Papillomavirus
DIVQSTCK

SEQ ID NO: 44819 - protein, 9 aa, Artificial Sequence
  Peptide Derived from Human Papillomavirus
DIVQSTCKY

SEQ ID NO: 44820 - protein, 9 aa, Artificial Sequence
  Peptide Derived from Human Papillomavirus
DLDQFPLGR

SEQ ID NO: 44821 - protein, 10 aa, Artificial Sequence
  Peptide Derived from Human Papillomavirus
DLDQFPLGRK

SEQ ID NO: 44822 - protein, 8 aa, Artificial Sequence
  Peptide Derived from Human Papillomavirus
DNISVDGK

SEQ ID NO: 44823 - protein, 9 aa, Artificial Sequence
  Peptide Derived from Human Papillomavirus
DNTKTNIPK

SEQ ID NO: 44824 - protein, 8 aa, Artificial Sequence
  Peptide Derived from Human Papillomavirus
DSMWFYLR

SEQ ID NO: 44825 - protein, 9 aa, Artificial Sequence
  Peptide Derived from Human Papillomavirus
DSMWFYLRR

SEQ ID NO: 44826 - protein, 11 aa, Artificial Sequence
  Peptide Derived from Human Papillomavirus
DSRDNISVDGK

SEQ ID NO: 44827 - protein, 11 aa, Artificial Sequence
  Peptide Derived from Human Papillomavirus
DSYVKRTSIFY

SEQ ID NO: 44828 - protein, 10 aa, Artificial Sequence
  Peptide Derived from Human Papillomavirus
DTGFGAMDFK

SEQ ID NO: 44829 - protein, 11 aa, Artificial Sequence
  Peptide Derived from Human Papillomavirus
DTNIYNPDQER

SEQ ID NO: 44830 - protein, 9 aa, Artificial Sequence
  Peptide Derived from Human Papillomavirus
EAQLFNKPY

SEQ ID NO: 44831 - protein, 8 aa, Artificial Sequence
  Peptide Derived from Human Papillomavirus
EDKYRYVR

SEQ ID NO: 44832 - protein, 10 aa, Artificial Sequence
  Peptide Derived from Human Papillomavirus
ELQFVFQLCK

SEQ ID NO: 44833 - protein, 10 aa, Artificial Sequence
  Peptide Derived from Human Papillomavirus
ELYLKGSNGR

SEQ ID NO: 44834 - protein, 8 aa, Artificial Sequence
  Peptide Derived from Human Papillomavirus
ETIPAELY

SEQ ID NO: 44835 - protein, 10 aa, Artificial Sequence
  Peptide Derived from Human Papillomavirus
ETIPAELYLK

SEQ ID NO: 44836 - protein, 8 aa, Artificial Sequence
  Peptide Derived from Human Papillomavirus
FARHYFNR

SEQ ID NO: 44837 - protein, 11 aa, Artificial Sequence
  Peptide Derived from Human Papillomavirus
FARHYFNRAGK

SEQ ID NO: 44838 - protein, 9 aa, Artificial Sequence
  Peptide Derived from Human Papillomavirus
FGLPDTNIY

SEQ ID NO: 44839 - protein, 8 aa, Artificial Sequence
  Peptide Derived from Human Papillomavirus
FLMQLGTR

SEQ ID NO: 44840 - protein, 10 aa, Artificial Sequence
  Peptide Derived from Human Papillomavirus
FLMQLGTRSK

SEQ ID NO: 44841 - protein, 8 aa, Artificial Sequence
  Peptide Derived from Human Papillomavirus
FLQMATWR

SEQ ID NO: 44842 - protein, 9 aa, Artificial Sequence
  Peptide Derived from Human Papillomavirus
FNKPYWLQR

SEQ ID NO: 44843 - protein, 9 aa, Artificial Sequence
  Peptide Derived from Human Papillomavirus
FVTVVDTTR

SEQ ID NO: 44844 - protein, 9 aa, Artificial Sequence
  Peptide Derived from Human Papillomavirus
GCTPAMGEH

SEQ ID NO: 44845 - protein, 9 aa, Artificial Sequence
  Peptide Derived from Human Papillomavirus
GDSMWFYLR

SEQ ID NO: 44846 - protein, 10 aa, Artificial Sequence
  Peptide Derived from Human Papillomavirus
GDSMWFYLRR

SEQ ID NO: 44847 - protein, 8 aa, Artificial Sequence
  Peptide Derived from Human Papillomavirus
GFGAMDFK

SEQ ID NO: 44848 - protein, 8 aa, Artificial Sequence
  Peptide Derived from Human Papillomavirus
GLPDTNIY

SEQ ID NO: 44849 - protein, 10 aa, Artificial Sequence
  Peptide Derived from Human Papillomavirus
GLSGHPLFNR

SEQ ID NO: 44850 - protein, 10 aa, Artificial Sequence
  Peptide Derived from Human Papillomavirus
GSSRLLAVGH

SEQ ID NO: 44851 - protein, 11 aa, Artificial Sequence
  Peptide Derived from Human Papillomavirus
IDTGFGAMDFK

SEQ ID NO: 44852 - protein, 9 aa, Artificial Sequence
  Peptide Derived from Human Papillomavirus
IFLQMATWR

SEQ ID NO: 44853 - protein, 9 aa, Artificial Sequence
  Peptide Derived from Human Papillomavirus
IFYHAGSSR

SEQ ID NO: 44854 - protein, 11 aa, Artificial Sequence
  Peptide Derived from Human Papillomavirus
INQYLRHVEEY

SEQ ID NO: 44855 - protein, 10 aa, Artificial Sequence
  Peptide Derived from Human Papillomavirus
ISTATEQLSK

SEQ ID NO: 44856 - protein, 11 aa, Artificial Sequence
  Peptide Derived from Human Papillomavirus
ISTATEQLSKY

SEQ ID NO: 44857 - protein, 10 aa, Artificial Sequence
  Peptide Derived from Human Papillomavirus
ITLSAEVMAY

SEQ ID NO: 44858 - protein, 10 aa, Artificial Sequence
  Peptide Derived from Human Papillomavirus
ITSEAQLFNK

SEQ ID NO: 44859 - protein, 11 aa, Artificial Sequence
  Peptide Derived from Human Papillomavirus
IVGCTPAMGEH

SEQ ID NO: 44860 - protein, 8 aa, Artificial Sequence
  Peptide Derived from Human Papillomavirus
IVQSTCKY

SEQ ID NO: 44861 - protein, 11 aa, Artificial Sequence
  Peptide Derived from Human Papillomavirus
IVQSTCKYPDY

SEQ ID NO: 44862 - protein, 10 aa, Artificial Sequence
  Peptide Derived from Human Papillomavirus
KDNTKTNIPK

SEQ ID NO: 44863 - protein, 10 aa, Artificial Sequence
  Peptide Derived from Human Papillomavirus
KFGLPDTNIY

SEQ ID NO: 44864 - protein, 9 aa, Artificial Sequence
  Peptide Derived from Human Papillomavirus
KFLMQLGTR

SEQ ID NO: 44865 - protein, 11 aa, Artificial Sequence
  Peptide Derived from Human Papillomavirus
KFLMQLGTRSK

SEQ ID NO: 44866 - protein, 8 aa, Artificial Sequence
  Peptide Derived from Human Papillomavirus
KINQYLRH

SEQ ID NO: 44867 - protein, 11 aa, Artificial Sequence
  Peptide Derived from Human Papillomavirus
KITLSAEVMAY

SEQ ID NO: 44868 - protein, 10 aa, Artificial Sequence
  Peptide Derived from Human Papillomavirus
KTNIPKVSAY

SEQ ID NO: 44869 - protein, 11 aa, Artificial Sequence
  Peptide Derived from Human Papillomavirus
KVGETIPAELY

SEQ ID NO: 44870 - protein, 8 aa, Artificial Sequence
  Peptide Derived from Human Papillomavirus
KVSAYQYR

SEQ ID NO: 44871 - protein, 11 aa, Artificial Sequence
  Peptide Derived from Human Papillomavirus
KVSAYQYRVFR

SEQ ID NO: 44872 - protein, 8 aa, Artificial Sequence
  Peptide Derived from Human Papillomavirus
KVVATDSY

SEQ ID NO: 44873 - protein, 10 aa, Artificial Sequence
  Peptide Derived from Human Papillomavirus
KVVATDSYVK

SEQ ID NO: 44874 - protein, 11 aa, Artificial Sequence
  Peptide Derived from Human Papillomavirus
KVVATDSYVKR

SEQ ID NO: 44875 - protein, 11 aa, Artificial Sequence
  Peptide Derived from Human Papillomavirus
KVYLPPTPVSK

SEQ ID NO: 44876 - protein, 11 aa, Artificial Sequence
  Peptide Derived from Human Papillomavirus
LANNNVIEDSR

SEQ ID NO: 44877 - protein, 8 aa, Artificial Sequence
  Peptide Derived from Human Papillomavirus
LAVGHPYY

SEQ ID NO: 44878 - protein, 9 aa, Artificial Sequence
  Peptide Derived from Human Papillomavirus
LDIVQSTCK

SEQ ID NO: 44879 - protein, 10 aa, Artificial Sequence
  Peptide Derived from Human Papillomavirus
LDIVQSTCKY

SEQ ID NO: 44880 - protein, 8 aa, Artificial Sequence
  Peptide Derived from Human Papillomavirus
LDQFPLGR

SEQ ID NO: 44881 - protein, 9 aa, Artificial Sequence
  Peptide Derived from Human Papillomavirus
LDQFPLGRK

SEQ ID NO: 44882 - protein, 9 aa, Artificial Sequence
  Peptide Derived from Human Papillomavirus
LFARHYFNR

SEQ ID NO: 44883 - protein, 10 aa, Artificial Sequence
  Peptide Derived from Human Papillomavirus
LFNKPYWLQR

SEQ ID NO: 44884 - protein, 10 aa, Artificial Sequence
  Peptide Derived from Human Papillomavirus
LFVTVVDTTR

SEQ ID NO: 44885 - protein, 8 aa, Artificial Sequence
  Peptide Derived from Human Papillomavirus
LGAGLSGH

SEQ ID NO: 44886 - protein, 8 aa, Artificial Sequence
  Peptide Derived from Human Papillomavirus
LLAVGHPY

SEQ ID NO: 44887 - protein, 9 aa, Artificial Sequence
  Peptide Derived from Human Papillomavirus
LLAVGHPYY

SEQ ID NO: 44888 - protein, 9 aa, Artificial Sequence
  Peptide Derived from Human Papillomavirus
LMQLGTRSK

SEQ ID NO: 44889 - protein, 8 aa, Artificial Sequence
  Peptide Derived from Human Papillomavirus
LSAEVMAY

SEQ ID NO: 44890 - protein, 10 aa, Artificial Sequence
  Peptide Derived from Human Papillomavirus
LSAEVMAYLH

SEQ ID NO: 44891 - protein, 9 aa, Artificial Sequence
  Peptide Derived from Human Papillomavirus
LSGHPLFNR

SEQ ID NO: 44892 - protein, 8 aa, Artificial Sequence
  Peptide Derived from Human Papillomavirus
LSKYDARK

SEQ ID NO: 44893 - protein, 10 aa, Artificial Sequence
  Peptide Derived from Human Papillomavirus
MATWRPSENK

SEQ ID NO: 44894 - protein, 10 aa, Artificial Sequence
  Peptide Derived from Human Papillomavirus
MDFKVLQESK

SEQ ID NO: 44895 - protein, 11 aa, Artificial Sequence
  Peptide Derived from Human Papillomavirus
MITSEAQLFNK

SEQ ID NO: 44896 - protein, 8 aa, Artificial Sequence
  Peptide Derived from Human Papillomavirus
MLPMMYIY

SEQ ID NO: 44897 - protein, 9 aa, Artificial Sequence
  Peptide Derived from Human Papillomavirus
MLPMMYIYR

SEQ ID NO: 44898 - protein, 9 aa, Artificial Sequence
  Peptide Derived from Human Papillomavirus
MMLPMMYIY

SEQ ID NO: 44899 - protein, 10 aa, Artificial Sequence
  Peptide Derived from Human Papillomavirus
MMLPMMYIYR

SEQ ID NO: 44900 - protein, 11 aa, Artificial Sequence
  Peptide Derived from Human Papillomavirus
MMYIYRDPPLH

SEQ ID NO: 44901 - protein, 11 aa, Artificial Sequence
  Peptide Derived from Human Papillomavirus
NGREPPPSSVY

SEQ ID NO: 44902 - protein, 8 aa, Artificial Sequence
  Peptide Derived from Human Papillomavirus
NIPKVSAY

SEQ ID NO: 44903 - protein, 10 aa, Artificial Sequence
  Peptide Derived from Human Papillomavirus
NIPKVSAYQY

SEQ ID NO: 44904 - protein, 11 aa, Artificial Sequence
  Peptide Derived from Human Papillomavirus
NIPKVSAYQYR

SEQ ID NO: 44905 - protein, 9 aa, Artificial Sequence
  Peptide Derived from Human Papillomavirus
NIYNPDQER

SEQ ID NO: 44906 - protein, 9 aa, Artificial Sequence
  Peptide Derived from Human Papillomavirus
NNNVIEDSR

SEQ ID NO: 44907 - protein, 8 aa, Artificial Sequence
  Peptide Derived from Human Papillomavirus
NNVIEDSR

SEQ ID NO: 44908 - protein, 8 aa, Artificial Sequence
  Peptide Derived from Human Papillomavirus
NTKTNIPK

SEQ ID NO: 44909 - protein, 9 aa, Artificial Sequence
  Peptide Derived from Human Papillomavirus
PAMGEHWTK

SEQ ID NO: 44910 - protein, 8 aa, Artificial Sequence
  Peptide Derived from Human Papillomavirus
PAVATSKK

SEQ ID NO: 44911 - protein, 9 aa, Artificial Sequence
  Peptide Derived from Human Papillomavirus
PAVATSKKR

SEQ ID NO: 44912 - protein, 11 aa, Artificial Sequence
  Peptide Derived from Human Papillomavirus
PDYLKMSADAY

SEQ ID NO: 44913 - protein, 10 aa, Artificial Sequence
  Peptide Derived from Human Papillomavirus
PIFLQMATWR

SEQ ID NO: 44914 - protein, 10 aa, Artificial Sequence
  Peptide Derived from Human Papillomavirus
PLDIVQSTCK

SEQ ID NO: 44915 - protein, 11 aa, Artificial Sequence
  Peptide Derived from Human Papillomavirus
PLDIVQSTCKY

SEQ ID NO: 44916 - protein, 9 aa, Artificial Sequence
  Peptide Derived from Human Papillomavirus
PLGAGLSGH

SEQ ID NO: 44917 - protein, 10 aa, Artificial Sequence
  Peptide Derived from Human Papillomavirus
PTEKQDPLAK

SEQ ID NO: 44918 - protein, 11 aa, Artificial Sequence
  Peptide Derived from Human Papillomavirus
PTEKQDPLAKY

SEQ ID NO: 44919 - protein, 9 aa, Artificial Sequence
  Peptide Derived from Human Papillomavirus
PTSTSTPAK

SEQ ID NO: 44920 - protein, 10 aa, Artificial Sequence
  Peptide Derived from Human Papillomavirus
PTSTSTPAKR

SEQ ID NO: 44921 - protein, 11 aa, Artificial Sequence
  Peptide Derived from Human Papillomavirus
PTSTSTPAKRK

SEQ ID NO: 44922 - protein, 9 aa, Artificial Sequence
  Peptide Derived from Human Papillomavirus
PVATSLEDK

SEQ ID NO: 44923 - protein, 10 aa, Artificial Sequence
  Peptide Derived from Human Papillomavirus
PVATSLEDKY

SEQ ID NO: 44924 - protein, 11 aa, Artificial Sequence
  Peptide Derived from Human Papillomavirus
PVATSLEDKYR

SEQ ID NO: 44925 - protein, 11 aa, Artificial Sequence
  Peptide Derived from Human Papillomavirus
PVSKVVATDSY

SEQ ID NO: 44926 - protein, 8 aa, Artificial Sequence
  Peptide Derived from Human Papillomavirus
QDPLAKYK

SEQ ID NO: 44927 - protein, 8 aa, Artificial Sequence
  Peptide Derived from Human Papillomavirus
QFVFQLCK

SEQ ID NO: 44928 - protein, 10 aa, Artificial Sequence
  Peptide Derived from Human Papillomavirus
QLFARHYFNR

SEQ ID NO: 44929 - protein, 11 aa, Artificial Sequence
  Peptide Derived from Human Papillomavirus
QLFNKPYWLQR

SEQ ID NO: 44930 - protein, 11 aa, Artificial Sequence
  Peptide Derived from Human Papillomavirus
QLFVTVVDTTR

SEQ ID NO: 44931 - protein, 8 aa, Artificial Sequence
  Peptide Derived from Human Papillomavirus
QLSKYDAR

SEQ ID NO: 44932 - protein, 9 aa, Artificial Sequence
  Peptide Derived from Human Papillomavirus
QLSKYDARK

SEQ ID NO: 44933 - protein, 11 aa, Artificial Sequence
  Peptide Derived from Human Papillomavirus
QMATWRPSENK

SEQ ID NO: 44934 - protein, 9 aa, Artificial Sequence
  Peptide Derived from Human Papillomavirus
QSTCKYPDY

SEQ ID NO: 44935 - protein, 11 aa, Artificial Sequence
  Peptide Derived from Human Papillomavirus
QSTCKYPDYLK

SEQ ID NO: 44936 - protein, 9 aa, Artificial Sequence
  Peptide Derived from Human Papillomavirus
RDNISVDGK

SEQ ID NO: 44937 - protein, 9 aa, Artificial Sequence
  Peptide Derived from Human Papillomavirus
RLLAVGHPY

SEQ ID NO: 44938 - protein, 10 aa, Artificial Sequence
  Peptide Derived from Human Papillomavirus
RLLAVGHPYY

SEQ ID NO: 44939 - protein, 10 aa, Artificial Sequence
  Peptide Derived from Human Papillomavirus
RSKPAVATSK

SEQ ID NO: 44940 - protein, 11 aa, Artificial Sequence
  Peptide Derived from Human Papillomavirus
RSKPAVATSKK

SEQ ID NO: 44941 - protein, 9 aa, Artificial Sequence
  Peptide Derived from Human Papillomavirus
RSTAITCQR

SEQ ID NO: 44942 - protein, 9 aa, Artificial Sequence
  Peptide Derived from Human Papillomavirus
RVRLPDPNK

SEQ ID NO: 44943 - protein, 9 aa, Artificial Sequence
  Peptide Derived from Human Papillomavirus
SAEVMAYLH

SEQ ID NO: 44944 - protein, 11 aa, Artificial Sequence
  Peptide Derived from Human Papillomavirus
SAPTSTSTPAK

SEQ ID NO: 44945 - protein, 9 aa, Artificial Sequence
  Peptide Derived from Human Papillomavirus
SAYQYRVFR

SEQ ID NO: 44946 - protein, 11 aa, Artificial Sequence
  Peptide Derived from Human Papillomavirus
SAYQYRVFRVR

SEQ ID NO: 44947 - protein, 8 aa, Artificial Sequence
  Peptide Derived from Human Papillomavirus
SGHPLFNR

SEQ ID NO: 44948 - protein, 10 aa, Artificial Sequence
  Peptide Derived from Human Papillomavirus
SIFYHAGSSR

SEQ ID NO: 44949 - protein, 8 aa, Artificial Sequence
  Peptide Derived from Human Papillomavirus
SLEDKYRY

SEQ ID NO: 44950 - protein, 10 aa, Artificial Sequence
  Peptide Derived from Human Papillomavirus
SLEDKYRYVR

SEQ ID NO: 44951 - protein, 8 aa, Artificial Sequence
  Peptide Derived from Human Papillomavirus
SMWFYLRR

SEQ ID NO: 44952 - protein, 9 aa, Artificial Sequence
  Peptide Derived from Human Papillomavirus
SSRLLAVGH

SEQ ID NO: 44953 - protein, 11 aa, Artificial Sequence
  Peptide Derived from Human Papillomavirus
SSRLLAVGHPY

SEQ ID NO: 44954 - protein, 8 aa, Artificial Sequence
  Peptide Derived from Human Papillomavirus
STAITCQR

SEQ ID NO: 44955 - protein, 9 aa, Artificial Sequence
  Peptide Derived from Human Papillomavirus
STATEQLSK

SEQ ID NO: 44956 - protein, 10 aa, Artificial Sequence
  Peptide Derived from Human Papillomavirus
STATEQLSKY

SEQ ID NO: 44957 - protein, 8 aa, Artificial Sequence
  Peptide Derived from Human Papillomavirus
STCKYPDY

SEQ ID NO: 44958 - protein, 10 aa, Artificial Sequence
  Peptide Derived from Human Papillomavirus
STCKYPDYLK

SEQ ID NO: 44959 - protein, 11 aa, Artificial Sequence
  Peptide Derived from Human Papillomavirus
STDLDQFPLGR

SEQ ID NO: 44960 - protein, 8 aa, Artificial Sequence
  Peptide Derived from Human Papillomavirus
STPAKRKR

SEQ ID NO: 44961 - protein, 9 aa, Artificial Sequence
  Peptide Derived from Human Papillomavirus
STPAKRKRR

SEQ ID NO: 44962 - protein, 8 aa, Artificial Sequence
  Peptide Derived from Human Papillomavirus
STSTPAKR

SEQ ID NO: 44963 - protein, 9 aa, Artificial Sequence
  Peptide Derived from Human Papillomavirus
STSTPAKRK

SEQ ID NO: 44964 - protein, 10 aa, Artificial Sequence
  Peptide Derived from Human Papillomavirus
STSTPAKRKR

SEQ ID NO: 44965 - protein, 11 aa, Artificial Sequence
  Peptide Derived from Human Papillomavirus
STSTPAKRKRR

SEQ ID NO: 44966 - protein, 8 aa, Artificial Sequence
  Peptide Derived from Human Papillomavirus
SVTKDNTK

SEQ ID NO: 44967 - protein, 8 aa, Artificial Sequence
  Peptide Derived from Human Papillomavirus
TATEQLSK

SEQ ID NO: 44968 - protein, 9 aa, Artificial Sequence
  Peptide Derived from Human Papillomavirus
TATEQLSKY

SEQ ID NO: 44969 - protein, 9 aa, Artificial Sequence
  Peptide Derived from Human Papillomavirus
TCKYPDYLK

SEQ ID NO: 44970 - protein, 11 aa, Artificial Sequence
  Peptide Derived from Human Papillomavirus
TCQREQPPTEK

SEQ ID NO: 44971 - protein, 10 aa, Artificial Sequence
  Peptide Derived from Human Papillomavirus
TDLDQFPLGR

SEQ ID NO: 44972 - protein, 11 aa, Artificial Sequence
  Peptide Derived from Human Papillomavirus
TDLDQFPLGRK

SEQ ID NO: 44973 - protein, 9 aa, Artificial Sequence
  Peptide Derived from Human Papillomavirus
TGFGAMDFK

SEQ ID NO: 44974 - protein, 9 aa, Artificial Sequence
  Peptide Derived from Human Papillomavirus
TIPAELYLK

SEQ ID NO: 44975 - protein, 11 aa, Artificial Sequence
  Peptide Derived from Human Papillomavirus
TISTATEQLSK

SEQ ID NO: 44976 - protein, 9 aa, Artificial Sequence
  Peptide Derived from Human Papillomavirus
TLSAEVMAY

SEQ ID NO: 44977 - protein, 11 aa, Artificial Sequence
  Peptide Derived from Human Papillomavirus
TLSAEVMAYLH

SEQ ID NO: 44978 - protein, 9 aa, Artificial Sequence
  Peptide Derived from Human Papillomavirus
TNIPKVSAY

SEQ ID NO: 44979 - protein, 11 aa, Artificial Sequence
  Peptide Derived from Human Papillomavirus
TNIPKVSAYQY

SEQ ID NO: 44980 - protein, 10 aa, Artificial Sequence
  Peptide Derived from Human Papillomavirus
TNIYNPDQER

SEQ ID NO: 44981 - protein, 9 aa, Artificial Sequence
  Peptide Derived from Human Papillomavirus
TSEAQLFNK

SEQ ID NO: 44982 - protein, 11 aa, Artificial Sequence
  Peptide Derived from Human Papillomavirus
TSEAQLFNKPY

SEQ ID NO: 44983 - protein, 11 aa, Artificial Sequence
  Peptide Derived from Human Papillomavirus
TSIFYHAGSSR

SEQ ID NO: 44984 - protein, 8 aa, Artificial Sequence
  Peptide Derived from Human Papillomavirus
TSLEDKYR

SEQ ID NO: 44985 - protein, 9 aa, Artificial Sequence
  Peptide Derived from Human Papillomavirus
TSLEDKYRY

SEQ ID NO: 44986 - protein, 11 aa, Artificial Sequence
  Peptide Derived from Human Papillomavirus
TSLEDKYRYVR

SEQ ID NO: 44987 - protein, 8 aa, Artificial Sequence
  Peptide Derived from Human Papillomavirus
TSTPAKRK

SEQ ID NO: 44988 - protein, 9 aa, Artificial Sequence
  Peptide Derived from Human Papillomavirus
TSTPAKRKR

SEQ ID NO: 44989 - protein, 10 aa, Artificial Sequence
  Peptide Derived from Human Papillomavirus
TSTPAKRKRR

SEQ ID NO: 44990 - protein, 8 aa, Artificial Sequence
  Peptide Derived from Human Papillomavirus
TSTSTPAK

SEQ ID NO: 44991 - protein, 9 aa, Artificial Sequence
  Peptide Derived from Human Papillomavirus
TSTSTPAKR

SEQ ID NO: 44992 - protein, 10 aa, Artificial Sequence
  Peptide Derived from Human Papillomavirus
TSTSTPAKRK

SEQ ID NO: 44993 - protein, 11 aa, Artificial Sequence
  Peptide Derived from Human Papillomavirus
TSTSTPAKRKR

SEQ ID NO: 44994 - protein, 8 aa, Artificial Sequence
  Peptide Derived from Human Papillomavirus
VATDSYVK

SEQ ID NO: 44995 - protein, 9 aa, Artificial Sequence
  Peptide Derived from Human Papillomavirus
VATDSYVKR

SEQ ID NO: 44996 - protein, 8 aa, Artificial Sequence
  Peptide Derived from Human Papillomavirus
VATSLEDK

SEQ ID NO: 44997 - protein, 9 aa, Artificial Sequence
  Peptide Derived from Human Papillomavirus
VATSLEDKY

SEQ ID NO: 44998 - protein, 10 aa, Artificial Sequence
  Peptide Derived from Human Papillomavirus
VATSLEDKYR

SEQ ID NO: 44999 - protein, 11 aa, Artificial Sequence
  Peptide Derived from Human Papillomavirus
VATSLEDKYRY

SEQ ID NO: 45000 - protein, 11 aa, Artificial Sequence
  Peptide Derived from Human Papillomavirus
VFRVRLPDPNK

SEQ ID NO: 45001 - protein, 10 aa, Artificial Sequence
  Peptide Derived from Human Papillomavirus
VGCTPAMGEH

SEQ ID NO: 45002 - protein, 10 aa, Artificial Sequence
  Peptide Derived from Human Papillomavirus
VGETIPAELY

SEQ ID NO: 45003 - protein, 10 aa, Artificial Sequence
  Peptide Derived from Human Papillomavirus
VGHPYYSVTK

SEQ ID NO: 45004 - protein, 10 aa, Artificial Sequence
  Peptide Derived from Human Papillomavirus
VSAYQYRVFR

SEQ ID NO: 45005 - protein, 10 aa, Artificial Sequence
  Peptide Derived from Human Papillomavirus
VSKVVATDSY

SEQ ID NO: 45006 - protein, 8 aa, Artificial Sequence
  Peptide Derived from Human Papillomavirus
VTVVDTTR

SEQ ID NO: 45007 - protein, 9 aa, Artificial Sequence
  Peptide Derived from Human Papillomavirus
VVATDSYVK

SEQ ID NO: 45008 - protein, 10 aa, Artificial Sequence
  Peptide Derived from Human Papillomavirus
VVATDSYVKR

SEQ ID NO: 45009 - protein, 10 aa, Artificial Sequence
  Peptide Derived from Human Papillomavirus
WACVGLEVGR

SEQ ID NO: 45010 - protein, 8 aa, Artificial Sequence
  Peptide Derived from Human Papillomavirus
WLQRAQGH

SEQ ID NO: 45011 - protein, 8 aa, Artificial Sequence
  Peptide Derived from Human Papillomavirus
WTKGAVCK

SEQ ID NO: 45012 - protein, 9 aa, Artificial Sequence
  Peptide Derived from Human Papillomavirus
YDARKINQY

SEQ ID NO: 45013 - protein, 11 aa, Artificial Sequence
  Peptide Derived from Human Papillomavirus
YDARKINQYLR

SEQ ID NO: 45014 - protein, 8 aa, Artificial Sequence
  Peptide Derived from Human Papillomavirus
YGDSMWFY

SEQ ID NO: 45015 - protein, 10 aa, Artificial Sequence
  Peptide Derived from Human Papillomavirus
YGDSMWFYLR

SEQ ID NO: 45016 - protein, 11 aa, Artificial Sequence
  Peptide Derived from Human Papillomavirus
YGDSMWFYLRR

SEQ ID NO: 45017 - protein, 9 aa, Artificial Sequence
  Peptide Derived from Human Papillomavirus
YIYRDPPLH

SEQ ID NO: 45018 - protein, 10 aa, Artificial Sequence
  Peptide Derived from Human Papillomavirus
YIYRDPPLHY

SEQ ID NO: 45019 - protein, 8 aa, Artificial Sequence
  Peptide Derived from Human Papillomavirus
YLKGSNGR

SEQ ID NO: 45020 - protein, 9 aa, Artificial Sequence
  Peptide Derived from Human Papillomavirus
YLKMSADAY

SEQ ID NO: 45021 - protein, 9 aa, Artificial Sequence
  Peptide Derived from Human Papillomavirus
YLPPTPVSK

SEQ ID NO: 45022 - protein, 8 aa, Artificial Sequence
  Peptide Derived from Human Papillomavirus
YLRHVEEY

SEQ ID NO: 45023 - protein, 10 aa, Artificial Sequence
  Peptide Derived from Human Papillomavirus
YLRREQLFAR

SEQ ID NO: 45024 - protein, 11 aa, Artificial Sequence
  Peptide Derived from Human Papillomavirus
YLRREQLFARH

SEQ ID NO: 45025 - protein, 9 aa, Artificial Sequence
  Peptide Derived from Human Papillomavirus
YSVTKDNTK

SEQ ID NO: 45026 - protein, 9 aa, Artificial Sequence
  Peptide Derived from Human Papillomavirus
YVKRTSIFY

SEQ ID NO: 45027 - protein, 10 aa, Artificial Sequence
  Peptide Derived from Human Papillomavirus
YVKRTSIFYH

SEQ ID NO: 45028 - protein, 11 aa, Artificial Sequence
  Peptide Derived from Human Papillomavirus
YVRSTAITCQR

SEQ ID NO: 45029 - protein, 8 aa, Artificial Sequence
  Peptide Derived from Human Papillomavirus
AAPRLYRK

SEQ ID NO: 45030 - protein, 10 aa, Artificial Sequence
  Peptide Derived from Human Papillomavirus
AFTTRRGGVR

SEQ ID NO: 45031 - protein, 9 aa, Artificial Sequence
  Peptide Derived from Human Papillomavirus
AGYVPLGSR

SEQ ID NO: 45032 - protein, 10 aa, Artificial Sequence
  Peptide Derived from Human Papillomavirus
ALHRPAFTTR

SEQ ID NO: 45033 - protein, 11 aa, Artificial Sequence
  Peptide Derived from Human Papillomavirus
ALHRPAFTTRR

SEQ ID NO: 45034 - protein, 9 aa, Artificial Sequence
  Peptide Derived from Human Papillomavirus
ALWPVYFFR

SEQ ID NO: 45035 - protein, 10 aa, Artificial Sequence
  Peptide Derived from Human Papillomavirus
ALWPVYFFRR

SEQ ID NO: 45036 - protein, 11 aa, Artificial Sequence
  Peptide Derived from Human Papillomavirus
ALWPVYFFRRR

SEQ ID NO: 45037 - protein, 9 aa, Artificial Sequence
  Peptide Derived from Human Papillomavirus
ANNSFDGLY

SEQ ID NO: 45038 - protein, 8 aa, Artificial Sequence
  Peptide Derived from Human Papillomavirus
ASATQLYK

SEQ ID NO: 45039 - protein, 11 aa, Artificial Sequence
  Peptide Derived from Human Papillomavirus
ASATQLYKTCK

SEQ ID NO: 45040 - protein, 10 aa, Artificial Sequence
  Peptide Derived from Human Papillomavirus
ATPSAHLPIK

SEQ ID NO: 45041 - protein, 9 aa, Artificial Sequence
  Peptide Derived from Human Papillomavirus
ATQLYKTCK

SEQ ID NO: 45042 - protein, 9 aa, Artificial Sequence
  Peptide Derived from Human Papillomavirus
DFMNIVALH

SEQ ID NO: 45043 - protein, 10 aa, Artificial Sequence
  Peptide Derived from Human Papillomavirus
DFMNIVALHR

SEQ ID NO: 45044 - protein, 10 aa, Artificial Sequence
  Peptide Derived from Human Papillomavirus
DITPTSSTVH

SEQ ID NO: 45045 - protein, 9 aa, Artificial Sequence
  Peptide Derived from Human Papillomavirus
DVVNKIEQK

SEQ ID NO: 45046 - protein, 10 aa, Artificial Sequence
  Peptide Derived from Human Papillomavirus
EDVVNKIEQK

SEQ ID NO: 45047 - protein, 10 aa, Artificial Sequence
  Peptide Derived from Human Papillomavirus
EIPMQTFAVH

SEQ ID NO: 45048 - protein, 10 aa, Artificial Sequence
  Peptide Derived from Human Papillomavirus
FALWPVYFFR

SEQ ID NO: 45049 - protein, 11 aa, Artificial Sequence
  Peptide Derived from Human Papillomavirus
FALWPVYFFRR

SEQ ID NO: 45050 - protein, 8 aa, Artificial Sequence
  Peptide Derived from Human Papillomavirus
FDGLYDIY

SEQ ID NO: 45051 - protein, 8 aa, Artificial Sequence
  Peptide Derived from Human Papillomavirus
FFRRRRRK

SEQ ID NO: 45052 - protein, 9 aa, Artificial Sequence
  Peptide Derived from Human Papillomavirus
FFRRRRRKR

SEQ ID NO: 45053 - protein, 8 aa, Artificial Sequence
  Peptide Derived from Human Papillomavirus
FMNIVALH

SEQ ID NO: 45054 - protein, 9 aa, Artificial Sequence
  Peptide Derived from Human Papillomavirus
FMNIVALHR

SEQ ID NO: 45055 - protein, 9 aa, Artificial Sequence
  Peptide Derived from Human Papillomavirus
FTTRRGGVR

SEQ ID NO: 45056 - protein, 11 aa, Artificial Sequence
  Peptide Derived from Human Papillomavirus
FVPQSPYDVTH

SEQ ID NO: 45057 - protein, 8 aa, Artificial Sequence
  Peptide Derived from Human Papillomavirus
GARVHYYY

SEQ ID NO: 45058 - protein, 9 aa, Artificial Sequence
  Peptide Derived from Human Papillomavirus
GFRRIAAPR

SEQ ID NO: 45059 - protein, 11 aa, Artificial Sequence
  Peptide Derived from Human Papillomavirus
GFRRIAAPRLY

SEQ ID NO: 45060 - protein, 10 aa, Artificial Sequence
  Peptide Derived from Human Papillomavirus
GGVRFSRLGR

SEQ ID NO: 45061 - protein, 11 aa, Artificial Sequence
  Peptide Derived from Human Papillomavirus
GGVRFSRLGRK

SEQ ID NO: 45062 - protein, 11 aa, Artificial Sequence
  Peptide Derived from Human Papillomavirus
GIGTGTGSGGR

SEQ ID NO: 45063 - protein, 9 aa, Artificial Sequence
  Peptide Derived from Human Papillomavirus
GNVWETPFY

SEQ ID NO: 45064 - protein, 8 aa, Artificial Sequence
  Peptide Derived from Human Papillomavirus
GSGGRAGY

SEQ ID NO: 45065 - protein, 10 aa, Artificial Sequence
  Peptide Derived from Human Papillomavirus
GSSFALWPVY

SEQ ID NO: 45066 - protein, 10 aa, Artificial Sequence
  Peptide Derived from Human Papillomavirus
GTCPEDVVNK

SEQ ID NO: 45067 - protein, 10 aa, Artificial Sequence
  Peptide Derived from Human Papillomavirus
GTGSGGRAGY

SEQ ID NO: 45068 - protein, 9 aa, Artificial Sequence
  Peptide Derived from Human Papillomavirus
GTGTGSGGR

SEQ ID NO: 45069 - protein, 9 aa, Artificial Sequence
  Peptide Derived from Human Papillomavirus
GTQIGARVH

SEQ ID NO: 45070 - protein, 10 aa, Artificial Sequence
  Peptide Derived from Human Papillomavirus
GTQIGARVHY

SEQ ID NO: 45071 - protein, 11 aa, Artificial Sequence
  Peptide Derived from Human Papillomavirus
GTQIGARVHYY

SEQ ID NO: 45072 - protein, 9 aa, Artificial Sequence
  Peptide Derived from Human Papillomavirus
GVRFSRLGR

SEQ ID NO: 45073 - protein, 10 aa, Artificial Sequence
  Peptide Derived from Human Papillomavirus
GVRFSRLGRK

SEQ ID NO: 45074 - protein, 8 aa, Artificial Sequence
  Peptide Derived from Human Papillomavirus
IAAPRLYR

SEQ ID NO: 45075 - protein, 9 aa, Artificial Sequence
  Peptide Derived from Human Papillomavirus
IAAPRLYRK

SEQ ID NO: 45076 - protein, 8 aa, Artificial Sequence
  Peptide Derived from Human Papillomavirus
IGARVHYY

SEQ ID NO: 45077 - protein, 9 aa, Artificial Sequence
  Peptide Derived from Human Papillomavirus
IGARVHYYY

SEQ ID NO: 45078 - protein, 10 aa, Artificial Sequence
  Peptide Derived from Human Papillomavirus
IGTGTGSGGR

SEQ ID NO: 45079 - protein, 11 aa, Artificial Sequence
  Peptide Derived from Human Papillomavirus
ILISTPTSGIH

SEQ ID NO: 45080 - protein, 10 aa, Artificial Sequence
  Peptide Derived from Human Papillomavirus
ILQWGSLFTY

SEQ ID NO: 45081 - protein, 10 aa, Artificial Sequence
  Peptide Derived from Human Papillomavirus
ISSTPIPGFR

SEQ ID NO: 45082 - protein, 11 aa, Artificial Sequence
  Peptide Derived from Human Papillomavirus
ISSTPIPGFRR

SEQ ID NO: 45083 - protein, 9 aa, Artificial Sequence
  Peptide Derived from Human Papillomavirus
ISTPTSGIH

SEQ ID NO: 45084 - protein, 11 aa, Artificial Sequence
  Peptide Derived from Human Papillomavirus
ISTPTSGIHSY

SEQ ID NO: 45085 - protein, 9 aa, Artificial Sequence
  Peptide Derived from Human Papillomavirus
ITPTSSTVH

SEQ ID NO: 45086 - protein, 8 aa, Artificial Sequence
  Peptide Derived from Human Papillomavirus
IVDVTPAR

SEQ ID NO: 45087 - protein, 8 aa, Artificial Sequence
  Peptide Derived from Human Papillomavirus
KATIQTRR

SEQ ID NO: 45088 - protein, 10 aa, Artificial Sequence
  Peptide Derived from Human Papillomavirus
KIEQKTWADK

SEQ ID NO: 45089 - protein, 11 aa, Artificial Sequence
  Peptide Derived from Human Papillomavirus
KILQWGSLFTY

SEQ ID NO: 45090 - protein, 10 aa, Artificial Sequence
  Peptide Derived from Human Papillomavirus
KVTDPAFLDR

SEQ ID NO: 45091 - protein, 11 aa, Artificial Sequence
  Peptide Derived from Human Papillomavirus
LDITPTSSTVH

SEQ ID NO: 45092 - protein, 10 aa, Artificial Sequence
  Peptide Derived from Human Papillomavirus
LGNVWETPFY

SEQ ID NO: 45093 - protein, 10 aa, Artificial Sequence
  Peptide Derived from Human Papillomavirus
LGRKATIQTR

SEQ ID NO: 45094 - protein, 11 aa, Artificial Sequence
  Peptide Derived from Human Papillomavirus
LGRKATIQTRR

SEQ ID NO: 45095 - protein, 10 aa, Artificial Sequence
  Peptide Derived from Human Papillomavirus
LISTPTSGIH

SEQ ID NO: 45096 - protein, 11 aa, Artificial Sequence
  Peptide Derived from Human Papillomavirus
LSANNSFDGLY

SEQ ID NO: 45097 - protein, 8 aa, Artificial Sequence
  Peptide Derived from Human Papillomavirus
MNIVALHR

SEQ ID NO: 45098 - protein, 8 aa, Artificial Sequence
  Peptide Derived from Human Papillomavirus
MVAHRATR

SEQ ID NO: 45099 - protein, 9 aa, Artificial Sequence
  Peptide Derived from Human Papillomavirus
MVAHRATRR

SEQ ID NO: 45100 - protein, 10 aa, Artificial Sequence
  Peptide Derived from Human Papillomavirus
MVAHRATRRK

SEQ ID NO: 45101 - protein, 11 aa, Artificial Sequence
  Peptide Derived from Human Papillomavirus
MVAHRATRRKR

SEQ ID NO: 45102 - protein, 8 aa, Artificial Sequence
  Peptide Derived from Human Papillomavirus
NNSFDGLY

SEQ ID NO: 45103 - protein, 11 aa, Artificial Sequence
  Peptide Derived from Human Papillomavirus
NNSFDGLYDIY

SEQ ID NO: 45104 - protein, 10 aa, Artificial Sequence
  Peptide Derived from Human Papillomavirus
NSFDGLYDIY

SEQ ID NO: 45105 - protein, 8 aa, Artificial Sequence
  Peptide Derived from Human Papillomavirus
NVWETPFY

SEQ ID NO: 45106 - protein, 11 aa, Artificial Sequence
  Peptide Derived from Human Papillomavirus
PAFTTRRGGVR

SEQ ID NO: 45107 - protein, 10 aa, Artificial Sequence
  Peptide Derived from Human Papillomavirus
PDFMNIVALH

SEQ ID NO: 45108 - protein, 11 aa, Artificial Sequence
  Peptide Derived from Human Papillomavirus
PDFMNIVALHR

SEQ ID NO: 45109 - protein, 8 aa, Artificial Sequence
  Peptide Derived from Human Papillomavirus
PFVPQSPY

SEQ ID NO: 45110 - protein, 10 aa, Artificial Sequence
  Peptide Derived from Human Papillomavirus
PGFRRIAAPR

SEQ ID NO: 45111 - protein, 11 aa, Artificial Sequence
  Peptide Derived from Human Papillomavirus
PISSTPIPGFR

SEQ ID NO: 45112 - protein, 11 aa, Artificial Sequence
  Peptide Derived from Human Papillomavirus
PLGNVWETPFY

SEQ ID NO: 45113 - protein, 8 aa, Artificial Sequence
  Peptide Derived from Human Papillomavirus
PMQTFAVH

SEQ ID NO: 45114 - protein, 8 aa, Artificial Sequence
  Peptide Derived from Human Papillomavirus
PSAHLPIK

SEQ ID NO: 45115 - protein, 11 aa, Artificial Sequence
  Peptide Derived from Human Papillomavirus
PSTIVDVTPAR

SEQ ID NO: 45116 - protein, 8 aa, Artificial Sequence
  Peptide Derived from Human Papillomavirus
PTSGIHSY

SEQ ID NO: 45117 - protein, 8 aa, Artificial Sequence
  Peptide Derived from Human Papillomavirus
PVYFFRRR

SEQ ID NO: 45118 - protein, 9 aa, Artificial Sequence
  Peptide Derived from Human Papillomavirus
PVYFFRRRR

SEQ ID NO: 45119 - protein, 10 aa, Artificial Sequence
  Peptide Derived from Human Papillomavirus
PVYFFRRRRR

SEQ ID NO: 45120 - protein, 11 aa, Artificial Sequence
  Peptide Derived from Human Papillomavirus
PVYFFRRRRRK

SEQ ID NO: 45121 - protein, 11 aa, Artificial Sequence
  Peptide Derived from Human Papillomavirus
QGSSFALWPVY

SEQ ID NO: 45122 - protein, 8 aa, Artificial Sequence
  Peptide Derived from Human Papillomavirus
QIGARVHY

SEQ ID NO: 45123 - protein, 9 aa, Artificial Sequence
  Peptide Derived from Human Papillomavirus
QIGARVHYY

SEQ ID NO: 45124 - protein, 10 aa, Artificial Sequence
  Peptide Derived from Human Papillomavirus
QIGARVHYYY

SEQ ID NO: 45125 - protein, 8 aa, Artificial Sequence
  Peptide Derived from Human Papillomavirus
QSPYDVTH

SEQ ID NO: 45126 - protein, 11 aa, Artificial Sequence
  Peptide Derived from Human Papillomavirus
QSPYDVTHDVY

SEQ ID NO: 45127 - protein, 9 aa, Artificial Sequence
  Peptide Derived from Human Papillomavirus
QSVATPSAH

SEQ ID NO: 45128 - protein, 11 aa, Artificial Sequence
  Peptide Derived from Human Papillomavirus
QTRRGTQIGAR

SEQ ID NO: 45129 - protein, 10 aa, Artificial Sequence
  Peptide Derived from Human Papillomavirus
RAGYVPLGSR

SEQ ID NO: 45130 - protein, 8 aa, Artificial Sequence
  Peptide Derived from Human Papillomavirus
RASATQLY

SEQ ID NO: 45131 - protein, 9 aa, Artificial Sequence
  Peptide Derived from Human Papillomavirus
RASATQLYK

SEQ ID NO: 45132 - protein, 8 aa, Artificial Sequence
  Peptide Derived from Human Papillomavirus
RFSRLGRK

SEQ ID NO: 45133 - protein, 8 aa, Artificial Sequence
  Peptide Derived from Human Papillomavirus
RGGVRFSR

SEQ ID NO: 45134 - protein, 11 aa, Artificial Sequence
  Peptide Derived from Human Papillomavirus
RGGVRFSRLGR

SEQ ID NO: 45135 - protein, 8 aa, Artificial Sequence
  Peptide Derived from Human Papillomavirus
RGTQIGAR

SEQ ID NO: 45136 - protein, 10 aa, Artificial Sequence
  Peptide Derived from Human Papillomavirus
RGTQIGARVH

SEQ ID NO: 45137 - protein, 11 aa, Artificial Sequence
  Peptide Derived from Human Papillomavirus
RGTQIGARVHY

SEQ ID NO: 45138 - protein, 8 aa, Artificial Sequence
  Peptide Derived from Human Papillomavirus
RIAAPRLY

SEQ ID NO: 45139 - protein, 9 aa, Artificial Sequence
  Peptide Derived from Human Papillomavirus
RIAAPRLYR

SEQ ID NO: 45140 - protein, 10 aa, Artificial Sequence
  Peptide Derived from Human Papillomavirus
RIAAPRLYRK

SEQ ID NO: 45141 - protein, 11 aa, Artificial Sequence
  Peptide Derived from Human Papillomavirus
RLGRKATIQTR

SEQ ID NO: 45142 - protein, 11 aa, Artificial Sequence
  Peptide Derived from Human Papillomavirus
RLYRKAFQQVK

SEQ ID NO: 45143 - protein, 10 aa, Artificial Sequence
  Peptide Derived from Human Papillomavirus
SANNSFDGLY

SEQ ID NO: 45144 - protein, 10 aa, Artificial Sequence
  Peptide Derived from Human Papillomavirus
SATQLYKTCK

SEQ ID NO: 45145 - protein, 8 aa, Artificial Sequence
  Peptide Derived from Human Papillomavirus
SFALWPVY

SEQ ID NO: 45146 - protein, 11 aa, Artificial Sequence
  Peptide Derived from Human Papillomavirus
SFALWPVYFFR

SEQ ID NO: 45147 - protein, 9 aa, Artificial Sequence
  Peptide Derived from Human Papillomavirus
SFDGLYDIY

SEQ ID NO: 45148 - protein, 11 aa, Artificial Sequence
  Peptide Derived from Human Papillomavirus
SGTCPEDVVNK

SEQ ID NO: 45149 - protein, 9 aa, Artificial Sequence
  Peptide Derived from Human Papillomavirus
SSFALWPVY

SEQ ID NO: 45150 - protein, 11 aa, Artificial Sequence
  Peptide Derived from Human Papillomavirus
SSQSVATPSAH

SEQ ID NO: 45151 - protein, 9 aa, Artificial Sequence
  Peptide Derived from Human Papillomavirus
SSTPIPGFR

SEQ ID NO: 45152 - protein, 10 aa, Artificial Sequence
  Peptide Derived from Human Papillomavirus
SSTPIPGFRR

SEQ ID NO: 45153 - protein, 10 aa, Artificial Sequence
  Peptide Derived from Human Papillomavirus
SSTVHVSSTH

SEQ ID NO: 45154 - protein, 10 aa, Artificial Sequence
  Peptide Derived from Human Papillomavirus
STIVDVTPAR

SEQ ID NO: 45155 - protein, 8 aa, Artificial Sequence
  Peptide Derived from Human Papillomavirus
STPIPGFR

SEQ ID NO: 45156 - protein, 9 aa, Artificial Sequence
  Peptide Derived from Human Papillomavirus
STPIPGFRR

SEQ ID NO: 45157 - protein, 8 aa, Artificial Sequence
  Peptide Derived from Human Papillomavirus
STPTSGIH

SEQ ID NO: 45158 - protein, 10 aa, Artificial Sequence
  Peptide Derived from Human Papillomavirus
STPTSGIHSY

SEQ ID NO: 45159 - protein, 9 aa, Artificial Sequence
  Peptide Derived from Human Papillomavirus
STVHVSSTH

SEQ ID NO: 45160 - protein, 11 aa, Artificial Sequence
  Peptide Derived from Human Papillomavirus
STWPFVPQSPY

SEQ ID NO: 45161 - protein, 8 aa, Artificial Sequence
  Peptide Derived from Human Papillomavirus
SVATPSAH

SEQ ID NO: 45162 - protein, 9 aa, Artificial Sequence
  Peptide Derived from Human Papillomavirus
TCPEDVVNK

SEQ ID NO: 45163 - protein, 8 aa, Artificial Sequence
  Peptide Derived from Human Papillomavirus
TDPAFLDR

SEQ ID NO: 45164 - protein, 9 aa, Artificial Sequence
  Peptide Derived from Human Papillomavirus
TGSGGRAGY

SEQ ID NO: 45165 - protein, 8 aa, Artificial Sequence
  Peptide Derived from Human Papillomavirus
TGTGSGGR

SEQ ID NO: 45166 - protein, 11 aa, Artificial Sequence
  Peptide Derived from Human Papillomavirus
TGTGSGGRAGY

SEQ ID NO: 45167 - protein, 9 aa, Artificial Sequence
  Peptide Derived from Human Papillomavirus
TIVDVTPAR

SEQ ID NO: 45168 - protein, 11 aa, Artificial Sequence
  Peptide Derived from Human Papillomavirus
TSSTVHVSSTH

SEQ ID NO: 45169 - protein, 8 aa, Artificial Sequence
  Peptide Derived from Human Papillomavirus
TTRRGGVR

SEQ ID NO: 45170 - protein, 11 aa, Artificial Sequence
  Peptide Derived from Human Papillomavirus
TTRRGGVRFSR

SEQ ID NO: 45171 - protein, 8 aa, Artificial Sequence
  Peptide Derived from Human Papillomavirus
TVHVSSTH

SEQ ID NO: 45172 - protein, 8 aa, Artificial Sequence
  Peptide Derived from Human Papillomavirus
VAHRATRR

SEQ ID NO: 45173 - protein, 9 aa, Artificial Sequence
  Peptide Derived from Human Papillomavirus
VAHRATRRK

SEQ ID NO: 45174 - protein, 10 aa, Artificial Sequence
  Peptide Derived from Human Papillomavirus
VAHRATRRKR

SEQ ID NO: 45175 - protein, 11 aa, Artificial Sequence
  Peptide Derived from Human Papillomavirus
VALHRPAFTTR

SEQ ID NO: 45176 - protein, 11 aa, Artificial Sequence
  Peptide Derived from Human Papillomavirus
VATPSAHLPIK

SEQ ID NO: 45177 - protein, 9 aa, Artificial Sequence
  Peptide Derived from Human Papillomavirus
VTDPAFLDR

SEQ ID NO: 45178 - protein, 8 aa, Artificial Sequence
  Peptide Derived from Human Papillomavirus
VVNKIEQK

SEQ ID NO: 45179 - protein, 8 aa, Artificial Sequence
  Peptide Derived from Human Papillomavirus
YDVTHDVY

SEQ ID NO: 45180 - protein, 8 aa, Artificial Sequence
  Peptide Derived from Human Papillomavirus
YFFRRRRR

SEQ ID NO: 45181 - protein, 9 aa, Artificial Sequence
  Peptide Derived from Human Papillomavirus
YFFRRRRRK

SEQ ID NO: 45182 - protein, 10 aa, Artificial Sequence
  Peptide Derived from Human Papillomavirus
YFFRRRRRKR

SEQ ID NO: 45183 - protein, 8 aa, Artificial Sequence
  Peptide Derived from Human Papillomavirus
AFGLTPSI

SEQ ID NO: 45184 - protein, 11 aa, Artificial Sequence
  Peptide Derived from Human Papillomavirus
AFLKSNSQAKI

SEQ ID NO: 45185 - protein, 9 aa, Artificial Sequence
  Peptide Derived from Human Papillomavirus
AMLAKFKEL

SEQ ID NO: 45186 - protein, 9 aa, Artificial Sequence
  Peptide Derived from Human Papillomavirus
CFVNSKSHF

SEQ ID NO: 45187 - protein, 10 aa, Artificial Sequence
  Peptide Derived from Human Papillomavirus
CFVNSKSHFW

SEQ ID NO: 45188 - protein, 11 aa, Artificial Sequence
  Peptide Derived from Human Papillomavirus
CFVNSKSHFWL

SEQ ID NO: 45189 - protein, 9 aa, Artificial Sequence
  Peptide Derived from Human Papillomavirus
CMMIEPPKL

SEQ ID NO: 45190 - protein, 9 aa, Artificial Sequence
  Peptide Derived from Human Papillomavirus
CWNYIDDNL

SEQ ID NO: 45191 - protein, 10 aa, Artificial Sequence
  Peptide Derived from Human Papillomavirus
DFIVNDNDYL

SEQ ID NO: 45192 - protein, 9 aa, Artificial Sequence
  Peptide Derived from Human Papillomavirus
DWCIAAFGL

SEQ ID NO: 45193 - protein, 8 aa, Artificial Sequence
  Peptide Derived from Human Papillomavirus
DWKQIVMF

SEQ ID NO: 45194 - protein, 9 aa, Artificial Sequence
  Peptide Derived from Human Papillomavirus
DWKQIVMFL

SEQ ID NO: 45195 - protein, 9 aa, Artificial Sequence
  Peptide Derived from Human Papillomavirus
EFMSFLTAL

SEQ ID NO: 45196 - protein, 9 aa, Artificial Sequence
  Peptide Derived from Human Papillomavirus
EWIQRQTVL

SEQ ID NO: 45197 - protein, 9 aa, Artificial Sequence
  Peptide Derived from Human Papillomavirus
FFSRTWSRL

SEQ ID NO: 45198 - protein, 11 aa, Artificial Sequence
  Peptide Derived from Human Papillomavirus
FFSRTWSRLSL

SEQ ID NO: 45199 - protein, 8 aa, Artificial Sequence
  Peptide Derived from Human Papillomavirus
FMSFLTAL

SEQ ID NO: 45200 - protein, 11 aa, Artificial Sequence
  Peptide Derived from Human Papillomavirus
FMSFLTALKRF

SEQ ID NO: 45201 - protein, 11 aa, Artificial Sequence
  Peptide Derived from Human Papillomavirus
FWLQPLADAKI

SEQ ID NO: 45202 - protein, 11 aa, Artificial Sequence
  Peptide Derived from Human Papillomavirus
GMLDDATVPCW

SEQ ID NO: 45203 - protein, 8 aa, Artificial Sequence
  Peptide Derived from Human Papillomavirus
GMSLMKFL

SEQ ID NO: 45204 - protein, 10 aa, Artificial Sequence
  Peptide Derived from Human Papillomavirus
KFKELYGVSF

SEQ ID NO: 45205 - protein, 8 aa, Artificial Sequence
  Peptide Derived from Human Papillomavirus
KFLQGSVI

SEQ ID NO: 45206 - protein, 10 aa, Artificial Sequence
  Peptide Derived from Human Papillomavirus
KFLQGSVICF

SEQ ID NO: 45207 - protein, 10 aa, Artificial Sequence
  Peptide Derived from Human Papillomavirus
KYLVSPLSDI

SEQ ID NO: 45208 - protein, 9 aa, Artificial Sequence
  Peptide Derived from Human Papillomavirus
LFGMSLMKF

SEQ ID NO: 45209 - protein, 10 aa, Artificial Sequence
  Peptide Derived from Human Papillomavirus
LFGMSLMKFL

SEQ ID NO: 45210 - protein, 10 aa, Artificial Sequence
  Peptide Derived from Human Papillomavirus
LMKFLQGSVI

SEQ ID NO: 45211 - protein, 11 aa, Artificial Sequence
  Peptide Derived from Human Papillomavirus
LYGAANTGKSL

SEQ ID NO: 45212 - protein, 9 aa, Artificial Sequence
  Peptide Derived from Human Papillomavirus
LYGVSFSEL

SEQ ID NO: 45213 - protein, 8 aa, Artificial Sequence
  Peptide Derived from Human Papillomavirus
LYLHIQSL

SEQ ID NO: 45214 - protein, 8 aa, Artificial Sequence
  Peptide Derived from Human Papillomavirus
LYWYKTGI

SEQ ID NO: 45215 - protein, 11 aa, Artificial Sequence
  Peptide Derived from Human Papillomavirus
LYWYKTGISNI

SEQ ID NO: 45216 - protein, 10 aa, Artificial Sequence
  Peptide Derived from Human Papillomavirus
MFLRYQGVEF

SEQ ID NO: 45217 - protein, 8 aa, Artificial Sequence
  Peptide Derived from Human Papillomavirus
MMIEPPKL

SEQ ID NO: 45218 - protein, 10 aa, Artificial Sequence
  Peptide Derived from Human Papillomavirus
NWKSFFSRTW

SEQ ID NO: 45219 - protein, 11 aa, Artificial Sequence
  Peptide Derived from Human Papillomavirus
NYIDDNLRNAL

SEQ ID NO: 45220 - protein, 11 aa, Artificial Sequence
  Peptide Derived from Human Papillomavirus
PMCMMIEPPKL

SEQ ID NO: 45221 - protein, 10 aa, Artificial Sequence
  Peptide Derived from Human Papillomavirus
PYLHNRLVVF

SEQ ID NO: 45222 - protein, 8 aa, Artificial Sequence
  Peptide Derived from Human Papillomavirus
QMSMSQWI

SEQ ID NO: 45223 - protein, 11 aa, Artificial Sequence
  Peptide Derived from Human Papillomavirus
QMVQWAYDNDI

SEQ ID NO: 45224 - protein, 8 aa, Artificial Sequence
  Peptide Derived from Human Papillomavirus
QWAYDNDI

SEQ ID NO: 45225 - protein, 8 aa, Artificial Sequence
  Peptide Derived from Human Papillomavirus
QYCLYLHI

SEQ ID NO: 45226 - protein, 11 aa, Artificial Sequence
  Peptide Derived from Human Papillomavirus
QYCLYLHIQSL

SEQ ID NO: 45227 - protein, 9 aa, Artificial Sequence
  Peptide Derived from Human Papillomavirus
RWPYLHNRL

SEQ ID NO: 45228 - protein, 11 aa, Artificial Sequence
  Peptide Derived from Human Papillomavirus
RYKCGKNRETI

SEQ ID NO: 45229 - protein, 10 aa, Artificial Sequence
  Peptide Derived from Human Papillomavirus
RYQGVEFMSF

SEQ ID NO: 45230 - protein, 11 aa, Artificial Sequence
  Peptide Derived from Human Papillomavirus
RYQGVEFMSFL

SEQ ID NO: 45231 - protein, 10 aa, Artificial Sequence
  Peptide Derived from Human Papillomavirus
SFFSRTWSRL

SEQ ID NO: 45232 - protein, 9 aa, Artificial Sequence
  Peptide Derived from Human Papillomavirus
SFLTALKRF

SEQ ID NO: 45233 - protein, 10 aa, Artificial Sequence
  Peptide Derived from Human Papillomavirus
SFLTALKRFL

SEQ ID NO: 45234 - protein, 9 aa, Artificial Sequence
  Peptide Derived from Human Papillomavirus
SFNDCTFEL

SEQ ID NO: 45235 - protein, 9 aa, Artificial Sequence
  Peptide Derived from Human Papillomavirus
SFSELVRPF

SEQ ID NO: 45236 - protein, 9 aa, Artificial Sequence
  Peptide Derived from Human Papillomavirus
SMDVKHRPL

SEQ ID NO: 45237 - protein, 8 aa, Artificial Sequence
  Peptide Derived from Human Papillomavirus
SWGMVVLL

SEQ ID NO: 45238 - protein, 9 aa, Artificial Sequence
  Peptide Derived from Human Papillomavirus
SWGMVVLLL

SEQ ID NO: 45239 - protein, 10 aa, Artificial Sequence
  Peptide Derived from Human Papillomavirus
TFELSQMVQW

SEQ ID NO: 45240 - protein, 8 aa, Artificial Sequence
  Peptide Derived from Human Papillomavirus
TFPNEFPF

SEQ ID NO: 45241 - protein, 8 aa, Artificial Sequence
  Peptide Derived from Human Papillomavirus
VFTFPNEF

SEQ ID NO: 45242 - protein, 10 aa, Artificial Sequence
  Peptide Derived from Human Papillomavirus
VFTFPNEFPF

SEQ ID NO: 45243 - protein, 11 aa, Artificial Sequence
  Peptide Derived from Human Papillomavirus
VMFLRYQGVEF

SEQ ID NO: 45244 - protein, 9 aa, Artificial Sequence
  Peptide Derived from Human Papillomavirus
VYELNDKNW

SEQ ID NO: 45245 - protein, 8 aa, Artificial Sequence
  Peptide Derived from Human Papillomavirus
VYGDTPEW

SEQ ID NO: 45246 - protein, 9 aa, Artificial Sequence
  Peptide Derived from Human Papillomavirus
VYGDTPEWI

SEQ ID NO: 45247 - protein, 9 aa, Artificial Sequence
  Peptide Derived from Human Papillomavirus
WYKTGISNI

SEQ ID NO: 45248 - protein, 10 aa, Artificial Sequence
  Peptide Derived from Human Papillomavirus
YWYKTGISNI

SEQ ID NO: 45249 - protein, 10 aa, Artificial Sequence
  Peptide Derived from Human Papillomavirus
AFNSSHKGRI

SEQ ID NO: 45250 - protein, 8 aa, Artificial Sequence
  Peptide Derived from Human Papillomavirus
DYWKHMRL

SEQ ID NO: 45251 - protein, 8 aa, Artificial Sequence
  Peptide Derived from Human Papillomavirus
EWQRDQFL

SEQ ID NO: 45252 - protein, 8 aa, Artificial Sequence
  Peptide Derived from Human Papillomavirus
GYTVEVQF

SEQ ID NO: 45253 - protein, 8 aa, Artificial Sequence
  Peptide Derived from Human Papillomavirus
HMRLECAI

SEQ ID NO: 45254 - protein, 9 aa, Artificial Sequence
  Peptide Derived from Human Papillomavirus
HYENDSTDL

SEQ ID NO: 45255 - protein, 8 aa, Artificial Sequence
  Peptide Derived from Human Papillomavirus
HYTNWTHI

SEQ ID NO: 45256 - protein, 10 aa, Artificial Sequence
  Peptide Derived from Human Papillomavirus
HYTNWTHIYI

SEQ ID NO: 45257 - protein, 11 aa, Artificial Sequence
  Peptide Derived from Human Papillomavirus
IYNSQYSNEKW

SEQ ID NO: 45258 - protein, 10 aa, Artificial Sequence
  Peptide Derived from Human Papillomavirus
IYYKAREMGF

SEQ ID NO: 45259 - protein, 9 aa, Artificial Sequence
  Peptide Derived from Human Papillomavirus
KWTLQDVSL

SEQ ID NO: 45260 - protein, 8 aa, Artificial Sequence
  Peptide Derived from Human Papillomavirus
KYSKNKVW

SEQ ID NO: 45261 - protein, 9 aa, Artificial Sequence
  Peptide Derived from Human Papillomavirus
LYTAVSSTW

SEQ ID NO: 45262 - protein, 11 aa, Artificial Sequence
  Peptide Derived from Human Papillomavirus
LYTAVSSTWHW

SEQ ID NO: 45263 - protein, 8 aa, Artificial Sequence
  Peptide Derived from Human Papillomavirus
LYYVHEGI

SEQ ID NO: 45264 - protein, 8 aa, Artificial Sequence
  Peptide Derived from Human Papillomavirus
QFLSQVKI

SEQ ID NO: 45265 - protein, 9 aa, Artificial Sequence
  Peptide Derived from Human Papillomavirus
QYSNEKWTL

SEQ ID NO: 45266 - protein, 8 aa, Artificial Sequence
  Peptide Derived from Human Papillomavirus
RFKKHCTL

SEQ ID NO: 45267 - protein, 10 aa, Artificial Sequence
  Peptide Derived from Human Papillomavirus
RYRFKKHCTL

SEQ ID NO: 45268 - protein, 10 aa, Artificial Sequence
  Peptide Derived from Human Papillomavirus
TMHYTNWTHI

SEQ ID NO: 45269 - protein, 11 aa, Artificial Sequence
  Peptide Derived from Human Papillomavirus
TYDSEWQRDQF

SEQ ID NO: 45270 - protein, 11 aa, Artificial Sequence
  Peptide Derived from Human Papillomavirus
VWEVHAGGQVI

SEQ ID NO: 45271 - protein, 10 aa, Artificial Sequence
  Peptide Derived from Human Papillomavirus
VYLTAPTGCI

SEQ ID NO: 45272 - protein, 11 aa, Artificial Sequence
  Peptide Derived from Human Papillomavirus
YWKHMRLECAI

SEQ ID NO: 45273 - protein, 11 aa, Artificial Sequence
  Peptide Derived from Human Papillomavirus
YYGLYYVHEGI

SEQ ID NO: 45274 - protein, 9 aa, Artificial Sequence
  Peptide Derived from Human Papillomavirus
YYKAREMGF

SEQ ID NO: 45275 - protein, 11 aa, Artificial Sequence
  Peptide Derived from Human Papillomavirus
YYVHEGIRTYF

SEQ ID NO: 45276 - protein, 9 aa, Artificial Sequence
  Peptide Derived from Human Papillomavirus
AFRCFIVYI

SEQ ID NO: 45277 - protein, 10 aa, Artificial Sequence
  Peptide Derived from Human Papillomavirus
AFRCFIVYII

SEQ ID NO: 45278 - protein, 11 aa, Artificial Sequence
  Peptide Derived from Human Papillomavirus
AFRCFIVYIIF

SEQ ID NO: 45279 - protein, 10 aa, Artificial Sequence
  Peptide Derived from Human Papillomavirus
CFCVLLCVCL

SEQ ID NO: 45280 - protein, 11 aa, Artificial Sequence
  Peptide Derived from Human Papillomavirus
CFCVLLCVCLL

SEQ ID NO: 45281 - protein, 8 aa, Artificial Sequence
  Peptide Derived from Human Papillomavirus
CFIVYIIF

SEQ ID NO: 45282 - protein, 11 aa, Artificial Sequence
  Peptide Derived from Human Papillomavirus
CFIVYIIFVYI

SEQ ID NO: 45283 - protein, 9 aa, Artificial Sequence
  Peptide Derived from Human Papillomavirus
CFLLCFCVL

SEQ ID NO: 45284 - protein, 10 aa, Artificial Sequence
  Peptide Derived from Human Papillomavirus
CFLLCFCVLL

SEQ ID NO: 45285 - protein, 8 aa, Artificial Sequence
  Peptide Derived from Human Papillomavirus
IFVYIPLF

SEQ ID NO: 45286 - protein, 9 aa, Artificial Sequence
  Peptide Derived from Human Papillomavirus
IFVYIPLFL

SEQ ID NO: 45287 - protein, 10 aa, Artificial Sequence
  Peptide Derived from Human Papillomavirus
IFVYIPLFLI

SEQ ID NO: 45288 - protein, 10 aa, Artificial Sequence
  Peptide Derived from Human Papillomavirus
LFLIHTHARF

SEQ ID NO: 45289 - protein, 11 aa, Artificial Sequence
  Peptide Derived from Human Papillomavirus
LFLIHTHARFL

SEQ ID NO: 45290 - protein, 9 aa, Artificial Sequence
  Peptide Derived from Human Papillomavirus
LWITAASAF

SEQ ID NO: 45291 - protein, 8 aa, Artificial Sequence
  Peptide Derived from Human Papillomavirus
TYTSLIIL

SEQ ID NO: 45292 - protein, 10 aa, Artificial Sequence
  Peptide Derived from Human Papillomavirus
TYTSLIILVL

SEQ ID NO: 45293 - protein, 11 aa, Artificial Sequence
  Peptide Derived from Human Papillomavirus
TYTSLIILVLL

SEQ ID NO: 45294 - protein, 8 aa, Artificial Sequence
  Peptide Derived from Human Papillomavirus
VYIIFVYI

SEQ ID NO: 45295 - protein, 10 aa, Artificial Sequence
  Peptide Derived from Human Papillomavirus
VYIIFVYIPL

SEQ ID NO: 45296 - protein, 11 aa, Artificial Sequence
  Peptide Derived from Human Papillomavirus
VYIIFVYIPLF

SEQ ID NO: 45297 - protein, 8 aa, Artificial Sequence
  Peptide Derived from Human Papillomavirus
VYIPLFLI

SEQ ID NO: 45298 - protein, 9 aa, Artificial Sequence
  Peptide Derived from Human Papillomavirus
CYSLYGTTL

SEQ ID NO: 45299 - protein, 9 aa, Artificial Sequence
  Peptide Derived from Human Papillomavirus
DFAFRDLCI

SEQ ID NO: 45300 - protein, 9 aa, Artificial Sequence
  Peptide Derived from Human Papillomavirus
EYRHYCYSL

SEQ ID NO: 45301 - protein, 11 aa, Artificial Sequence
  Peptide Derived from Human Papillomavirus
HYCYSLYGTTL

SEQ ID NO: 45302 - protein, 9 aa, Artificial Sequence
  Peptide Derived from Human Papillomavirus
PYAVCDKCL

SEQ ID NO: 45303 - protein, 11 aa, Artificial Sequence
  Peptide Derived from Human Papillomavirus
PYAVCDKCLKF

SEQ ID NO: 45304 - protein, 9 aa, Artificial Sequence
  Peptide Derived from Human Papillomavirus
QYNKPLCDL

SEQ ID NO: 45305 - protein, 10 aa, Artificial Sequence
  Peptide Derived from Human Papillomavirus
QYNKPLCDLL

SEQ ID NO: 45306 - protein, 11 aa, Artificial Sequence
  Peptide Derived from Human Papillomavirus
QYNKPLCDLLI

SEQ ID NO: 45307 - protein, 9 aa, Artificial Sequence
  Peptide Derived from Human Papillomavirus
RFHNIRGRW

SEQ ID NO: 45308 - protein, 8 aa, Artificial Sequence
  Peptide Derived from Human Papillomavirus
VYCKQQLL

SEQ ID NO: 45309 - protein, 9 aa, Artificial Sequence
  Peptide Derived from Human Papillomavirus
VYDFAFRDL

SEQ ID NO: 45310 - protein, 11 aa, Artificial Sequence
  Peptide Derived from Human Papillomavirus
VYDFAFRDLCI

SEQ ID NO: 45311 - protein, 11 aa, Artificial Sequence
  Peptide Derived from Human Papillomavirus
LMGTLGIVCPI

SEQ ID NO: 45312 - protein, 10 aa, Artificial Sequence
  Peptide Derived from Human Papillomavirus
TFCCKCDSTL

SEQ ID NO: 45313 - protein, 11 aa, Artificial Sequence
  Peptide Derived from Human Papillomavirus
CYENDVNVYHI

SEQ ID NO: 45314 - protein, 9 aa, Artificial Sequence
  Peptide Derived from Human Papillomavirus
DYKQTQLCL

SEQ ID NO: 45315 - protein, 10 aa, Artificial Sequence
  Peptide Derived from Human Papillomavirus
DYKQTQLCLI

SEQ ID NO: 45316 - protein, 8 aa, Artificial Sequence
  Peptide Derived from Human Papillomavirus
EYDLQFIF

SEQ ID NO: 45317 - protein, 10 aa, Artificial Sequence
  Peptide Derived from Human Papillomavirus
EYDLQFIFQL

SEQ ID NO: 45318 - protein, 11 aa, Artificial Sequence
  Peptide Derived from Human Papillomavirus
EYLRHGEEYDL

SEQ ID NO: 45319 - protein, 8 aa, Artificial Sequence
  Peptide Derived from Human Papillomavirus
EYVARTNI

SEQ ID NO: 45320 - protein, 8 aa, Artificial Sequence
  Peptide Derived from Human Papillomavirus
FFQMSLWL

SEQ ID NO: 45321 - protein, 10 aa, Artificial Sequence
  Peptide Derived from Human Papillomavirus
FFYLRREQMF

SEQ ID NO: 45322 - protein, 10 aa, Artificial Sequence
  Peptide Derived from Human Papillomavirus
FWEVNLKEKF

SEQ ID NO: 45323 - protein, 9 aa, Artificial Sequence
  Peptide Derived from Human Papillomavirus
FYLRREQMF

SEQ ID NO: 45324 - protein, 9 aa, Artificial Sequence
  Peptide Derived from Human Papillomavirus
FYNPDTQRL

SEQ ID NO: 45325 - protein, 11 aa, Artificial Sequence
  Peptide Derived from Human Papillomavirus
FYNPDTQRLVW

SEQ ID NO: 45326 - protein, 10 aa, Artificial Sequence
  Peptide Derived from Human Papillomavirus
GFGAMDFTTL

SEQ ID NO: 45327 - protein, 8 aa, Artificial Sequence
  Peptide Derived from Human Papillomavirus
IFFQMSLW

SEQ ID NO: 45328 - protein, 9 aa, Artificial Sequence
  Peptide Derived from Human Papillomavirus
IFFQMSLWL

SEQ ID NO: 45329 - protein, 8 aa, Artificial Sequence
  Peptide Derived from Human Papillomavirus
IFNKPYWL

SEQ ID NO: 45330 - protein, 9 aa, Artificial Sequence
  Peptide Derived from Human Papillomavirus
IFQLCKITL

SEQ ID NO: 45331 - protein, 10 aa, Artificial Sequence
  Peptide Derived from Human Papillomavirus
IYYHAGTSRL

SEQ ID NO: 45332 - protein, 11 aa, Artificial Sequence
  Peptide Derived from Human Papillomavirus
IYYHAGTSRLL

SEQ ID NO: 45333 - protein, 9 aa, Artificial Sequence
  Peptide Derived from Human Papillomavirus
KFGFPDTSF

SEQ ID NO: 45334 - protein, 8 aa, Artificial Sequence
  Peptide Derived from Human Papillomavirus
KFLLQAGL

SEQ ID NO: 45335 - protein, 9 aa, Artificial Sequence
  Peptide Derived from Human Papillomavirus
KFSADLDQF

SEQ ID NO: 45336 - protein, 11 aa, Artificial Sequence
  Peptide Derived from Human Papillomavirus
KFSADLDQFPL

SEQ ID NO: 45337 - protein, 11 aa, Artificial Sequence
  Peptide Derived from Human Papillomavirus
KMVSEPYGDSL

SEQ ID NO: 45338 - protein, 9 aa, Artificial Sequence
  Peptide Derived from Human Papillomavirus
KYTFWEVNL

SEQ ID NO: 45339 - protein, 11 aa, Artificial Sequence
  Peptide Derived from Human Papillomavirus
LFFYLRREQMF

SEQ ID NO: 45340 - protein, 11 aa, Artificial Sequence
  Peptide Derived from Human Papillomavirus
LWLPSEATVYL

SEQ ID NO: 45341 - protein, 8 aa, Artificial Sequence
  Peptide Derived from Human Papillomavirus
NMSLCAAI

SEQ ID NO: 45342 - protein, 8 aa, Artificial Sequence
  Peptide Derived from Human Papillomavirus
PYGDSLFF

SEQ ID NO: 45343 - protein, 10 aa, Artificial Sequence
  Peptide Derived from Human Papillomavirus
PYGDSLFFYL

SEQ ID NO: 45344 - protein, 9 aa, Artificial Sequence
  Peptide Derived from Human Papillomavirus
QFIFQLCKI

SEQ ID NO: 45345 - protein, 11 aa, Artificial Sequence
  Peptide Derived from Human Papillomavirus
QFIFQLCKITL

SEQ ID NO: 45346 - protein, 8 aa, Artificial Sequence
  Peptide Derived from Human Papillomavirus
QFPLGRKF

SEQ ID NO: 45347 - protein, 9 aa, Artificial Sequence
  Peptide Derived from Human Papillomavirus
QFPLGRKFL

SEQ ID NO: 45348 - protein, 10 aa, Artificial Sequence
  Peptide Derived from Human Papillomavirus
QFPLGRKFLL

SEQ ID NO: 45349 - protein, 8 aa, Artificial Sequence
  Peptide Derived from Human Papillomavirus
QMFVRHLF

SEQ ID NO: 45350 - protein, 9 aa, Artificial Sequence
  Peptide Derived from Human Papillomavirus
QYRVFRIHL

SEQ ID NO: 45351 - protein, 8 aa, Artificial Sequence
  Peptide Derived from Human Papillomavirus
RFVTSQAI

SEQ ID NO: 45352 - protein, 10 aa, Artificial Sequence
  Peptide Derived from Human Papillomavirus
SFYNPDTQRL

SEQ ID NO: 45353 - protein, 9 aa, Artificial Sequence
  Peptide Derived from Human Papillomavirus
SMDYKQTQL

SEQ ID NO: 45354 - protein, 11 aa, Artificial Sequence
  Peptide Derived from Human Papillomavirus
SMDYKQTQLCL

SEQ ID NO: 45355 - protein, 10 aa, Artificial Sequence
  Peptide Derived from Human Papillomavirus
SMNSTILEDW

SEQ ID NO: 45356 - protein, 9 aa, Artificial Sequence
  Peptide Derived from Human Papillomavirus
SMVTSDAQI

SEQ ID NO: 45357 - protein, 10 aa, Artificial Sequence
  Peptide Derived from Human Papillomavirus
SMVTSDAQIF

SEQ ID NO: 45358 - protein, 8 aa, Artificial Sequence
  Peptide Derived from Human Papillomavirus
TFIYILVI

SEQ ID NO: 45359 - protein, 11 aa, Artificial Sequence
  Peptide Derived from Human Papillomavirus
TFWEVNLKEKF

SEQ ID NO: 45360 - protein, 10 aa, Artificial Sequence
  Peptide Derived from Human Papillomavirus
TYIHSMNSTI

SEQ ID NO: 45361 - protein, 11 aa, Artificial Sequence
  Peptide Derived from Human Papillomavirus
TYIHSMNSTIL

SEQ ID NO: 45362 - protein, 11 aa, Artificial Sequence
  Peptide Derived from Human Papillomavirus
TYKNTNFKEYL

SEQ ID NO: 45363 - protein, 10 aa, Artificial Sequence
  Peptide Derived from Human Papillomavirus
TYRFVTSQAI

SEQ ID NO: 45364 - protein, 10 aa, Artificial Sequence
  Peptide Derived from Human Papillomavirus
VYHIFFQMSL

SEQ ID NO: 45365 - protein, 11 aa, Artificial Sequence
  Peptide Derived from Human Papillomavirus
VYHIFFQMSLW

SEQ ID NO: 45366 - protein, 9 aa, Artificial Sequence
  Peptide Derived from Human Papillomavirus
YYHAGTSRL

SEQ ID NO: 45367 - protein, 10 aa, Artificial Sequence
  Peptide Derived from Human Papillomavirus
YYHAGTSRLL

SEQ ID NO: 45368 - protein, 9 aa, Artificial Sequence
  Peptide Derived from Human Papillomavirus
AFITTPTKL

SEQ ID NO: 45369 - protein, 10 aa, Artificial Sequence
  Peptide Derived from Human Papillomavirus
AFITTPTKLI

SEQ ID NO: 45370 - protein, 11 aa, Artificial Sequence
  Peptide Derived from Human Papillomavirus
AYEGIDVDNTL

SEQ ID NO: 45371 - protein, 8 aa, Artificial Sequence
  Peptide Derived from Human Papillomavirus
DFLDIVAL

SEQ ID NO: 45372 - protein, 11 aa, Artificial Sequence
  Peptide Derived from Human Papillomavirus
DFSTIDSAEEI

SEQ ID NO: 45373 - protein, 11 aa, Artificial Sequence
  Peptide Derived from Human Papillomavirus
DFYLHPSYYML

SEQ ID NO: 45374 - protein, 10 aa, Artificial Sequence
  Peptide Derived from Human Papillomavirus
FYLHPSYYML

SEQ ID NO: 45375 - protein, 9 aa, Artificial Sequence
  Peptide Derived from Human Papillomavirus
GYIPANTTI

SEQ ID NO: 45376 - protein, 11 aa, Artificial Sequence
  Peptide Derived from Human Papillomavirus
GYIPANTTIPF

SEQ ID NO: 45377 - protein, 9 aa, Artificial Sequence
  Peptide Derived from Human Papillomavirus
HFTLSSSTI

SEQ ID NO: 45378 - protein, 9 aa, Artificial Sequence
  Peptide Derived from Human Papillomavirus
HYYYDFSTI

SEQ ID NO: 45379 - protein, 9 aa, Artificial Sequence
  Peptide Derived from Human Papillomavirus
LYDIYADDF

SEQ ID NO: 45380 - protein, 10 aa, Artificial Sequence
  Peptide Derived from Human Papillomavirus
LYDIYADDFI

SEQ ID NO: 45381 - protein, 10 aa, Artificial Sequence
  Peptide Derived from Human Papillomavirus
LYFSSNDNSI

SEQ ID NO: 45382 - protein, 10 aa, Artificial Sequence
  Peptide Derived from Human Papillomavirus
NYEEIPMDTF

SEQ ID NO: 45383 - protein, 11 aa, Artificial Sequence
  Peptide Derived from Human Papillomavirus
NYEEIPMDTFI

SEQ ID NO: 45384 - protein, 8 aa, Artificial Sequence
  Peptide Derived from Human Papillomavirus
PFGGAYNI

SEQ ID NO: 45385 - protein, 10 aa, Artificial Sequence
  Peptide Derived from Human Papillomavirus
PFGGAYNIPL

SEQ ID NO: 45386 - protein, 9 aa, Artificial Sequence
  Peptide Derived from Human Papillomavirus
PYFFSDVSL

SEQ ID NO: 45387 - protein, 8 aa, Artificial Sequence
  Peptide Derived from Human Papillomavirus
QYGSMGVF

SEQ ID NO: 45388 - protein, 9 aa, Artificial Sequence
  Peptide Derived from Human Papillomavirus
QYGSMGVFF

SEQ ID NO: 45389 - protein, 11 aa, Artificial Sequence
  Peptide Derived from Human Papillomavirus
QYTIIADAGDF

SEQ ID NO: 45390 - protein, 11 aa, Artificial Sequence
  Peptide Derived from Human Papillomavirus
RYSRIGNKQTL

SEQ ID NO: 45391 - protein, 9 aa, Artificial Sequence
  Peptide Derived from Human Papillomavirus
SMGVFFGGL

SEQ ID NO: 45392 - protein, 11 aa, Artificial Sequence
  Peptide Derived from Human Papillomavirus
SMGVFFGGLGI

SEQ ID NO: 45393 - protein, 8 aa, Artificial Sequence
  Peptide Derived from Human Papillomavirus
TFTDPSVL

SEQ ID NO: 45394 - protein, 10 aa, Artificial Sequence
  Peptide Derived from Human Papillomavirus
TYDNPAYEGI

SEQ ID NO: 45395 - protein, 10 aa, Artificial Sequence
  Peptide Derived from Human Papillomavirus
TYTTTSHAAL

SEQ ID NO: 45396 - protein, 8 aa, Artificial Sequence
  Peptide Derived from Human Papillomavirus
VFFGGLGI

SEQ ID NO: 45397 - protein, 8 aa, Artificial Sequence
  Peptide Derived from Human Papillomavirus
YFFSDVSL

SEQ ID NO: 45398 - protein, 9 aa, Artificial Sequence
  Peptide Derived from Human Papillomavirus
YFSSNDNSI

SEQ ID NO: 45399 - protein, 11 aa, Artificial Sequence
  Peptide Derived from Human Papillomavirus
YFSSNDNSINI

SEQ ID NO: 45400 - protein, 10 aa, Artificial Sequence
  Peptide Derived from Human Papillomavirus
YMLRKRRKRL

SEQ ID NO: 45401 - protein, 11 aa, Artificial Sequence
  Peptide Derived from Human Papillomavirus
YYMLRKRRKRL

SEQ ID NO: 45402 - protein, 8 aa, Artificial Sequence
  Peptide Derived from Human Papillomavirus
YYYDFSTI

SEQ ID NO: 45403 - protein, 11 aa, Artificial Sequence
  Peptide Derived from Human Papillomavirus
AMLDDATTTCW

SEQ ID NO: 45404 - protein, 10 aa, Artificial Sequence
  Peptide Derived from Human Papillomavirus
CFFERTWSRL

SEQ ID NO: 45405 - protein, 9 aa, Artificial Sequence
  Peptide Derived from Human Papillomavirus
CMLIQPPKL

SEQ ID NO: 45406 - protein, 9 aa, Artificial Sequence
  Peptide Derived from Human Papillomavirus
DFIDTQGTF

SEQ ID NO: 45407 - protein, 8 aa, Artificial Sequence
  Peptide Derived from Human Papillomavirus
DMAFEYAL

SEQ ID NO: 45408 - protein, 9 aa, Artificial Sequence
  Peptide Derived from Human Papillomavirus
DMAFEYALL

SEQ ID NO: 45409 - protein, 8 aa, Artificial Sequence
  Peptide Derived from Human Papillomavirus
DWRPIVQF

SEQ ID NO: 45410 - protein, 9 aa, Artificial Sequence
  Peptide Derived from Human Papillomavirus
DWRPIVQFL

SEQ ID NO: 45411 - protein, 9 aa, Artificial Sequence
  Peptide Derived from Human Papillomavirus
EFITFLGAL

SEQ ID NO: 45412 - protein, 8 aa, Artificial Sequence
  Peptide Derived from Human Papillomavirus
EFPNAFPF

SEQ ID NO: 45413 - protein, 11 aa, Artificial Sequence
  Peptide Derived from Human Papillomavirus
EMVQWAFDNEL

SEQ ID NO: 45414 - protein, 8 aa, Artificial Sequence
  Peptide Derived from Human Papillomavirus
EWIQRLTI

SEQ ID NO: 45415 - protein, 9 aa, Artificial Sequence
  Peptide Derived from Human Papillomavirus
EWIQRLTII

SEQ ID NO: 45416 - protein, 9 aa, Artificial Sequence
  Peptide Derived from Human Papillomavirus
FFERTWSRL

SEQ ID NO: 45417 - protein, 11 aa, Artificial Sequence
  Peptide Derived from Human Papillomavirus
FFERTWSRLDL

SEQ ID NO: 45418 - protein, 9 aa, Artificial Sequence
  Peptide Derived from Human Papillomavirus
GFKTLIQPF

SEQ ID NO: 45419 - protein, 10 aa, Artificial Sequence
  Peptide Derived from Human Papillomavirus
GFKTLIQPFI

SEQ ID NO: 45420 - protein, 11 aa, Artificial Sequence
  Peptide Derived from Human Papillomavirus
GFKTLIQPFIL

SEQ ID NO: 45421 - protein, 8 aa, Artificial Sequence
  Peptide Derived from Human Papillomavirus
GMSFIHFI

SEQ ID NO: 45422 - protein, 8 aa, Artificial Sequence
  Peptide Derived from Human Papillomavirus
GWFYVQAI

SEQ ID NO: 45423 - protein, 8 aa, Artificial Sequence
  Peptide Derived from Human Papillomavirus
HFIQGAVI

SEQ ID NO: 45424 - protein, 10 aa, Artificial Sequence
  Peptide Derived from Human Papillomavirus
HFIQGAVISF

SEQ ID NO: 45425 - protein, 8 aa, Artificial Sequence
  Peptide Derived from Human Papillomavirus
IFGVNPTI

SEQ ID NO: 45426 - protein, 9 aa, Artificial Sequence
  Peptide Derived from Human Papillomavirus
KWGVLILAL

SEQ ID NO: 45427 - protein, 10 aa, Artificial Sequence
  Peptide Derived from Human Papillomavirus
KWGVLILALL

SEQ ID NO: 45428 - protein, 8 aa, Artificial Sequence
  Peptide Derived from Human Papillomavirus
LYAHIQCL

SEQ ID NO: 45429 - protein, 8 aa, Artificial Sequence
  Peptide Derived from Human Papillomavirus
LYWYRTGI

SEQ ID NO: 45430 - protein, 11 aa, Artificial Sequence
  Peptide Derived from Human Papillomavirus
LYWYRTGISNI

SEQ ID NO: 45431 - protein, 10 aa, Artificial Sequence
  Peptide Derived from Human Papillomavirus
NFDLSEMVQW

SEQ ID NO: 45432 - protein, 8 aa, Artificial Sequence
  Peptide Derived from Human Papillomavirus
NMSQWIRF

SEQ ID NO: 45433 - protein, 10 aa, Artificial Sequence
  Peptide Derived from Human Papillomavirus
NWKCFFERTW

SEQ ID NO: 45434 - protein, 8 aa, Artificial Sequence
  Peptide Derived from Human Papillomavirus
PFILYAHI

SEQ ID NO: 45435 - protein, 11 aa, Artificial Sequence
  Peptide Derived from Human Papillomavirus
PFILYAHIQCL

SEQ ID NO: 45436 - protein, 10 aa, Artificial Sequence
  Peptide Derived from Human Papillomavirus
PYLESRITVF

SEQ ID NO: 45437 - protein, 8 aa, Artificial Sequence
  Peptide Derived from Human Papillomavirus
QFLRYQQI

SEQ ID NO: 45438 - protein, 10 aa, Artificial Sequence
  Peptide Derived from Human Papillomavirus
QFLRYQQIEF

SEQ ID NO: 45439 - protein, 11 aa, Artificial Sequence
  Peptide Derived from Human Papillomavirus
QFLRYQQIEFI

SEQ ID NO: 45440 - protein, 8 aa, Artificial Sequence
  Peptide Derived from Human Papillomavirus
QMNMSQWI

SEQ ID NO: 45441 - protein, 10 aa, Artificial Sequence
  Peptide Derived from Human Papillomavirus
QMNMSQWIRF

SEQ ID NO: 45442 - protein, 8 aa, Artificial Sequence
  Peptide Derived from Human Papillomavirus
QWAFDNEL

SEQ ID NO: 45443 - protein, 10 aa, Artificial Sequence
  Peptide Derived from Human Papillomavirus
QWIRFRCSKI

SEQ ID NO: 45444 - protein, 9 aa, Artificial Sequence
  Peptide Derived from Human Papillomavirus
RWPYLESRI

SEQ ID NO: 45445 - protein, 9 aa, Artificial Sequence
  Peptide Derived from Human Papillomavirus
RYKCGKSRL

SEQ ID NO: 45446 - protein, 8 aa, Artificial Sequence
  Peptide Derived from Human Papillomavirus
RYQQIEFI

SEQ ID NO: 45447 - protein, 10 aa, Artificial Sequence
  Peptide Derived from Human Papillomavirus
RYQQIEFITF

SEQ ID NO: 45448 - protein, 11 aa, Artificial Sequence
  Peptide Derived from Human Papillomavirus
RYQQIEFITFL

SEQ ID NO: 45449 - protein, 11 aa, Artificial Sequence
  Peptide Derived from Human Papillomavirus
SFIHFIQGAVI

SEQ ID NO: 45450 - protein, 9 aa, Artificial Sequence
  Peptide Derived from Human Papillomavirus
SFTDLVRNF

SEQ ID NO: 45451 - protein, 9 aa, Artificial Sequence
  Peptide Derived from Human Papillomavirus
SFVNSTSHF

SEQ ID NO: 45452 - protein, 10 aa, Artificial Sequence
  Peptide Derived from Human Papillomavirus
SFVNSTSHFW

SEQ ID NO: 45453 - protein, 11 aa, Artificial Sequence
  Peptide Derived from Human Papillomavirus
SFVNSTSHFWL

SEQ ID NO: 45454 - protein, 8 aa, Artificial Sequence
  Peptide Derived from Human Papillomavirus
SYFGMSFI

SEQ ID NO: 45455 - protein, 10 aa, Artificial Sequence
  Peptide Derived from Human Papillomavirus
SYFGMSFIHF

SEQ ID NO: 45456 - protein, 11 aa, Artificial Sequence
  Peptide Derived from Human Papillomavirus
SYFGMSFIHFI

SEQ ID NO: 45457 - protein, 8 aa, Artificial Sequence
  Peptide Derived from Human Papillomavirus
TFCEQAEL

SEQ ID NO: 45458 - protein, 9 aa, Artificial Sequence
  Peptide Derived from Human Papillomavirus
TFLGALKSF

SEQ ID NO: 45459 - protein, 10 aa, Artificial Sequence
  Peptide Derived from Human Papillomavirus
TFLGALKSFL

SEQ ID NO: 45460 - protein, 11 aa, Artificial Sequence
  Peptide Derived from Human Papillomavirus
TYFDTYMRNAL

SEQ ID NO: 45461 - protein, 9 aa, Artificial Sequence
  Peptide Derived from Human Papillomavirus
TYGLSFTDL

SEQ ID NO: 45462 - protein, 8 aa, Artificial Sequence
  Peptide Derived from Human Papillomavirus
VFEFPNAF

SEQ ID NO: 45463 - protein, 10 aa, Artificial Sequence
  Peptide Derived from Human Papillomavirus
VFEFPNAFPF

SEQ ID NO: 45464 - protein, 8 aa, Artificial Sequence
  Peptide Derived from Human Papillomavirus
VFKDTYGL

SEQ ID NO: 45465 - protein, 10 aa, Artificial Sequence
  Peptide Derived from Human Papillomavirus
VFKDTYGLSF

SEQ ID NO: 45466 - protein, 8 aa, Artificial Sequence
  Peptide Derived from Human Papillomavirus
VMGDTPEW

SEQ ID NO: 45467 - protein, 9 aa, Artificial Sequence
  Peptide Derived from Human Papillomavirus
VMGDTPEWI

SEQ ID NO: 45468 - protein, 9 aa, Artificial Sequence
  Peptide Derived from Human Papillomavirus
VYEINDKNW

SEQ ID NO: 45469 - protein, 9 aa, Artificial Sequence
  Peptide Derived from Human Papillomavirus
WYRTGISNI

SEQ ID NO: 45470 - protein, 10 aa, Artificial Sequence
  Peptide Derived from Human Papillomavirus
YFDTYMRNAL

SEQ ID NO: 45471 - protein, 9 aa, Artificial Sequence
  Peptide Derived from Human Papillomavirus
YFGMSFIHF

SEQ ID NO: 45472 - protein, 10 aa, Artificial Sequence
  Peptide Derived from Human Papillomavirus
YFGMSFIHFI

SEQ ID NO: 45473 - protein, 11 aa, Artificial Sequence
  Peptide Derived from Human Papillomavirus
YMRNALDGNPI

SEQ ID NO: 45474 - protein, 10 aa, Artificial Sequence
  Peptide Derived from Human Papillomavirus
YWYRTGISNI

SEQ ID NO: 45475 - protein, 11 aa, Artificial Sequence
  Peptide Derived from Human Papillomavirus
DWTLQDTCEEL

SEQ ID NO: 45476 - protein, 9 aa, Artificial Sequence
  Peptide Derived from Human Papillomavirus
FFAAREHGI

SEQ ID NO: 45477 - protein, 9 aa, Artificial Sequence
  Peptide Derived from Human Papillomavirus
GYNTFYIEF

SEQ ID NO: 45478 - protein, 9 aa, Artificial Sequence
  Peptide Derived from Human Papillomavirus
HYENDSKDI

SEQ ID NO: 45479 - protein, 9 aa, Artificial Sequence
  Peptide Derived from Human Papillomavirus
HYRDISSTW

SEQ ID NO: 45480 - protein, 11 aa, Artificial Sequence
  Peptide Derived from Human Papillomavirus
HYRDISSTWHW

SEQ ID NO: 45481 - protein, 10 aa, Artificial Sequence
  Peptide Derived from Human Papillomavirus
IFFAAREHGI

SEQ ID NO: 45482 - protein, 8 aa, Artificial Sequence
  Peptide Derived from Human Papillomavirus
KFLNTVAI

SEQ ID NO: 45483 - protein, 8 aa, Artificial Sequence
  Peptide Derived from Human Papillomavirus
KYGNTGTW

SEQ ID NO: 45484 - protein, 10 aa, Artificial Sequence
  Peptide Derived from Human Papillomavirus
LWNTEPTHCF

SEQ ID NO: 45485 - protein, 11 aa, Artificial Sequence
  Peptide Derived from Human Papillomavirus
LYYVKEGYNTF

SEQ ID NO: 45486 - protein, 8 aa, Artificial Sequence
  Peptide Derived from Human Papillomavirus
QYWQLIRW

SEQ ID NO: 45487 - protein, 8 aa, Artificial Sequence
  Peptide Derived from Human Papillomavirus
RWENAIFF

SEQ ID NO: 45488 - protein, 9 aa, Artificial Sequence
  Peptide Derived from Human Papillomavirus
RYKTEDWTL

SEQ ID NO: 45489 - protein, 11 aa, Artificial Sequence
  Peptide Derived from Human Papillomavirus
TWEVHFGNNVI

SEQ ID NO: 45490 - protein, 11 aa, Artificial Sequence
  Peptide Derived from Human Papillomavirus
TYHSETQRTKF

SEQ ID NO: 45491 - protein, 10 aa, Artificial Sequence
  Peptide Derived from Human Papillomavirus
VYYMTDAGTW

SEQ ID NO: 45492 - protein, 8 aa, Artificial Sequence
  Peptide Derived from Human Papillomavirus
YMTDAGTW

SEQ ID NO: 45493 - protein, 11 aa, Artificial Sequence
  Peptide Derived from Human Papillomavirus
YWQLIRWENAI

SEQ ID NO: 45494 - protein, 9 aa, Artificial Sequence
  Peptide Derived from Human Papillomavirus
YYMTDAGTW

SEQ ID NO: 45495 - protein, 10 aa, Artificial Sequence
  Peptide Derived from Human Papillomavirus
YYVKEGYNTF

SEQ ID NO: 45496 - protein, 9 aa, Artificial Sequence
  Peptide Derived from Human Papillomavirus
AFTVYVFCF

SEQ ID NO: 45497 - protein, 10 aa, Artificial Sequence
  Peptide Derived from Human Papillomavirus
AFTVYVFCFL

SEQ ID NO: 45498 - protein, 11 aa, Artificial Sequence
  Peptide Derived from Human Papillomavirus
AFTVYVFCFLL

SEQ ID NO: 45499 - protein, 9 aa, Artificial Sequence
  Peptide Derived from Human Papillomavirus
AWVLVFVYI

SEQ ID NO: 45500 - protein, 8 aa, Artificial Sequence
  Peptide Derived from Human Papillomavirus
AYAWVLVF

SEQ ID NO: 45501 - protein, 11 aa, Artificial Sequence
  Peptide Derived from Human Papillomavirus
AYAWVLVFVYI

SEQ ID NO: 45502 - protein, 8 aa, Artificial Sequence
  Peptide Derived from Human Papillomavirus
CFLLPMLL

SEQ ID NO: 45503 - protein, 9 aa, Artificial Sequence
  Peptide Derived from Human Papillomavirus
CFLLPMLLL

SEQ ID NO: 45504 - protein, 11 aa, Artificial Sequence
  Peptide Derived from Human Papillomavirus
CFLLPMLLLHI

SEQ ID NO: 45505 - protein, 9 aa, Artificial Sequence
  Peptide Derived from Human Papillomavirus
CMCAYAWVL

SEQ ID NO: 45506 - protein, 11 aa, Artificial Sequence
  Peptide Derived from Human Papillomavirus
CMCAYAWVLVF

SEQ ID NO: 45507 - protein, 10 aa, Artificial Sequence
  Peptide Derived from Human Papillomavirus
CMYVCCHVPL

SEQ ID NO: 45508 - protein, 11 aa, Artificial Sequence
  Peptide Derived from Human Papillomavirus
CMYVCCHVPLL

SEQ ID NO: 45509 - protein, 9 aa, Artificial Sequence
  Peptide Derived from Human Papillomavirus
MYVCCHVPL

SEQ ID NO: 45510 - protein, 10 aa, Artificial Sequence
  Peptide Derived from Human Papillomavirus
MYVCCHVPLL

SEQ ID NO: 45511 - protein, 10 aa, Artificial Sequence
  Peptide Derived from Human Papillomavirus
PMLLLHIHAI

SEQ ID NO: 45512 - protein, 11 aa, Artificial Sequence
  Peptide Derived from Human Papillomavirus
PMLLLHIHAIL

SEQ ID NO: 45513 - protein, 9 aa, Artificial Sequence
  Peptide Derived from Human Papillomavirus
VFCFLLPML

SEQ ID NO: 45514 - protein, 10 aa, Artificial Sequence
  Peptide Derived from Human Papillomavirus
VFCFLLPMLL

SEQ ID NO: 45515 - protein, 11 aa, Artificial Sequence
  Peptide Derived from Human Papillomavirus
VFCFLLPMLLL

SEQ ID NO: 45516 - protein, 8 aa, Artificial Sequence
  Peptide Derived from Human Papillomavirus
VFVYIVVI

SEQ ID NO: 45517 - protein, 8 aa, Artificial Sequence
  Peptide Derived from Human Papillomavirus
VYVFCFLL

SEQ ID NO: 45518 - protein, 11 aa, Artificial Sequence
  Peptide Derived from Human Papillomavirus
VYVFCFLLPML

SEQ ID NO: 45519 - protein, 9 aa, Artificial Sequence
  Peptide Derived from Human Papillomavirus
DFYSRIREL

SEQ ID NO: 45520 - protein, 8 aa, Artificial Sequence
  Peptide Derived from Human Papillomavirus
EFAFKDLF

SEQ ID NO: 45521 - protein, 8 aa, Artificial Sequence
  Peptide Derived from Human Papillomavirus
FYSRIREL

SEQ ID NO: 45522 - protein, 11 aa, Artificial Sequence
  Peptide Derived from Human Papillomavirus
HYSDSVYGDTL

SEQ ID NO: 45523 - protein, 9 aa, Artificial Sequence
  Peptide Derived from Human Papillomavirus
LFVVYRDSI

SEQ ID NO: 45524 - protein, 9 aa, Artificial Sequence
  Peptide Derived from Human Papillomavirus
LYNLLIRCL

SEQ ID NO: 45525 - protein, 11 aa, Artificial Sequence
  Peptide Derived from Human Papillomavirus
PYKLPDLCTEL

SEQ ID NO: 45526 - protein, 9 aa, Artificial Sequence
  Peptide Derived from Human Papillomavirus
VFEFAFKDL

SEQ ID NO: 45527 - protein, 10 aa, Artificial Sequence
  Peptide Derived from Human Papillomavirus
VFEFAFKDLF

SEQ ID NO: 45528 - protein, 9 aa, Artificial Sequence
  Peptide Derived from Human Papillomavirus
VYCKTVLEL

SEQ ID NO: 45529 - protein, 9 aa, Artificial Sequence
  Peptide Derived from Human Papillomavirus
VYGDTLEKL

SEQ ID NO: 45530 - protein, 10 aa, Artificial Sequence
  Peptide Derived from Human Papillomavirus
AFQQLFLNTL

SEQ ID NO: 45531 - protein, 10 aa, Artificial Sequence
  Peptide Derived from Human Papillomavirus
CMCCKCEARI

SEQ ID NO: 45532 - protein, 8 aa, Artificial Sequence
  Peptide Derived from Human Papillomavirus
LFLNTLSF

SEQ ID NO: 45533 - protein, 11 aa, Artificial Sequence
  Peptide Derived from Human Papillomavirus
AYQYRVFRVQL

SEQ ID NO: 45534 - protein, 9 aa, Artificial Sequence
  Peptide Derived from Human Papillomavirus
DYKQTQLCI

SEQ ID NO: 45535 - protein, 10 aa, Artificial Sequence
  Peptide Derived from Human Papillomavirus
DYKQTQLCIL

SEQ ID NO: 45536 - protein, 8 aa, Artificial Sequence
  Peptide Derived from Human Papillomavirus
DYVTPTSI

SEQ ID NO: 45537 - protein, 9 aa, Artificial Sequence
  Peptide Derived from Human Papillomavirus
DYVTPTSIF

SEQ ID NO: 45538 - protein, 8 aa, Artificial Sequence
  Peptide Derived from Human Papillomavirus
EYDLQFIF

SEQ ID NO: 45539 - protein, 10 aa, Artificial Sequence
  Peptide Derived from Human Papillomavirus
EYDLQFIFQL

SEQ ID NO: 45540 - protein, 9 aa, Artificial Sequence
  Peptide Derived from Human Papillomavirus
FFCLRREQL

SEQ ID NO: 45541 - protein, 10 aa, Artificial Sequence
  Peptide Derived from Human Papillomavirus
FFCLRREQLF

SEQ ID NO: 45542 - protein, 10 aa, Artificial Sequence
  Peptide Derived from Human Papillomavirus
FWNVDLKEKF

SEQ ID NO: 45543 - protein, 9 aa, Artificial Sequence
  Peptide Derived from Human Papillomavirus
FYHAGSSRL

SEQ ID NO: 45544 - protein, 10 aa, Artificial Sequence
  Peptide Derived from Human Papillomavirus
FYHAGSSRLL

SEQ ID NO: 45545 - protein, 10 aa, Artificial Sequence
  Peptide Derived from Human Papillomavirus
GYGAMDFSTL

SEQ ID NO: 45546 - protein, 11 aa, Artificial Sequence
  Peptide Derived from Human Papillomavirus
HYHLLPLYGPL

SEQ ID NO: 45547 - protein, 8 aa, Artificial Sequence
  Peptide Derived from Human Papillomavirus
IFLQMALW

SEQ ID NO: 45548 - protein, 9 aa, Artificial Sequence
  Peptide Derived from Human Papillomavirus
IFQLCTITL

SEQ ID NO: 45549 - protein, 10 aa, Artificial Sequence
  Peptide Derived from Human Papillomavirus
IFYHAGSSRL

SEQ ID NO: 45550 - protein, 11 aa, Artificial Sequence
  Peptide Derived from Human Papillomavirus
IFYHAGSSRLL

SEQ ID NO: 45551 - protein, 9 aa, Artificial Sequence
  Peptide Derived from Human Papillomavirus
IYNPETQRL

SEQ ID NO: 45552 - protein, 11 aa, Artificial Sequence
  Peptide Derived from Human Papillomavirus
IYNPETQRLVW

SEQ ID NO: 45553 - protein, 9 aa, Artificial Sequence
  Peptide Derived from Human Papillomavirus
KFGLPDTSI

SEQ ID NO: 45554 - protein, 8 aa, Artificial Sequence
  Peptide Derived from Human Papillomavirus
KFLVQAGL

SEQ ID NO: 45555 - protein, 11 aa, Artificial Sequence
  Peptide Derived from Human Papillomavirus
KFSLDLDQYPL

SEQ ID NO: 45556 - protein, 11 aa, Artificial Sequence
  Peptide Derived from Human Papillomavirus
KFWNVDLKEKF

SEQ ID NO: 45557 - protein, 9 aa, Artificial Sequence
  Peptide Derived from Human Papillomavirus
LFLRNVNVF

SEQ ID NO: 45558 - protein, 11 aa, Artificial Sequence
  Peptide Derived from Human Papillomavirus
LFLRNVNVFPI

SEQ ID NO: 45559 - protein, 8 aa, Artificial Sequence
  Peptide Derived from Human Papillomavirus
LFNKPYWL

SEQ ID NO: 45560 - protein, 11 aa, Artificial Sequence
  Peptide Derived from Human Papillomavirus
LWRPSDNTVYL

SEQ ID NO: 45561 - protein, 11 aa, Artificial Sequence
  Peptide Derived from Human Papillomavirus
LYGPLYHPRPL

SEQ ID NO: 45562 - protein, 9 aa, Artificial Sequence
  Peptide Derived from Human Papillomavirus
LYHPRPLPL

SEQ ID NO: 45563 - protein, 8 aa, Artificial Sequence
  Peptide Derived from Human Papillomavirus
LYTRVLIL

SEQ ID NO: 45564 - protein, 10 aa, Artificial Sequence
  Peptide Derived from Human Papillomavirus
MFFCLRREQL

SEQ ID NO: 45565 - protein, 11 aa, Artificial Sequence
  Peptide Derived from Human Papillomavirus
MFFCLRREQLF

SEQ ID NO: 45566 - protein, 8 aa, Artificial Sequence
  Peptide Derived from Human Papillomavirus
PYDKLKFW

SEQ ID NO: 45567 - protein, 8 aa, Artificial Sequence
  Peptide Derived from Human Papillomavirus
PYGDSMFF

SEQ ID NO: 45568 - protein, 10 aa, Artificial Sequence
  Peptide Derived from Human Papillomavirus
PYGDSMFFCL

SEQ ID NO: 45569 - protein, 9 aa, Artificial Sequence
  Peptide Derived from Human Papillomavirus
QFIFQLCTI

SEQ ID NO: 45570 - protein, 11 aa, Artificial Sequence
  Peptide Derived from Human Papillomavirus
QFIFQLCTITL

SEQ ID NO: 45571 - protein, 8 aa, Artificial Sequence
  Peptide Derived from Human Papillomavirus
QYPLGRKF

SEQ ID NO: 45572 - protein, 9 aa, Artificial Sequence
  Peptide Derived from Human Papillomavirus
QYPLGRKFL

SEQ ID NO: 45573 - protein, 9 aa, Artificial Sequence
  Peptide Derived from Human Papillomavirus
QYRVFRVQL

SEQ ID NO: 45574 - protein, 11 aa, Artificial Sequence
  Peptide Derived from Human Papillomavirus
QYSRHVEEYDL

SEQ ID NO: 45575 - protein, 8 aa, Artificial Sequence
  Peptide Derived from Human Papillomavirus
RFVQSVAI

SEQ ID NO: 45576 - protein, 11 aa, Artificial Sequence
  Peptide Derived from Human Papillomavirus
SMFFCLRREQL

SEQ ID NO: 45577 - protein, 10 aa, Artificial Sequence
  Peptide Derived from Human Papillomavirus
SMNSSILEDW

SEQ ID NO: 45578 - protein, 10 aa, Artificial Sequence
  Peptide Derived from Human Papillomavirus
SYIHSMNSSI

SEQ ID NO: 45579 - protein, 11 aa, Artificial Sequence
  Peptide Derived from Human Papillomavirus
SYIHSMNSSIL

SEQ ID NO: 45580 - protein, 10 aa, Artificial Sequence
  Peptide Derived from Human Papillomavirus
TMGDTVPQSL

SEQ ID NO: 45581 - protein, 10 aa, Artificial Sequence
  Peptide Derived from Human Papillomavirus
TYRFVQSVAI

SEQ ID NO: 45582 - protein, 10 aa, Artificial Sequence
  Peptide Derived from Human Papillomavirus
VFPIFLQMAL

SEQ ID NO: 45583 - protein, 11 aa, Artificial Sequence
  Peptide Derived from Human Papillomavirus
VFPIFLQMALW

SEQ ID NO: 45584 - protein, 9 aa, Artificial Sequence
  Peptide Derived from Human Papillomavirus
VWACAGVEI

SEQ ID NO: 45585 - protein, 8 aa, Artificial Sequence
  Peptide Derived from Human Papillomavirus
VYMVHIII

SEQ ID NO: 45586 - protein, 10 aa, Artificial Sequence
  Peptide Derived from Human Papillomavirus
VYSPSPSGSI

SEQ ID NO: 45587 - protein, 9 aa, Artificial Sequence
  Peptide Derived from Human Papillomavirus
AFEPVDTTL

SEQ ID NO: 45588 - protein, 11 aa, Artificial Sequence
  Peptide Derived from Human Papillomavirus
AFEPVDTTLTF

SEQ ID NO: 45589 - protein, 9 aa, Artificial Sequence
  Peptide Derived from Human Papillomavirus
AFFKYSPTI

SEQ ID NO: 45590 - protein, 8 aa, Artificial Sequence
  Peptide Derived from Human Papillomavirus
AFSDPSII

SEQ ID NO: 45591 - protein, 8 aa, Artificial Sequence
  Peptide Derived from Human Papillomavirus
DFMDIIRL

SEQ ID NO: 45592 - protein, 9 aa, Artificial Sequence
  Peptide Derived from Human Papillomavirus
EFLTRPSSL

SEQ ID NO: 45593 - protein, 10 aa, Artificial Sequence
  Peptide Derived from Human Papillomavirus
EFLTRPSSLI

SEQ ID NO: 45594 - protein, 8 aa, Artificial Sequence
  Peptide Derived from Human Papillomavirus
EYIELQPL

SEQ ID NO: 45595 - protein, 8 aa, Artificial Sequence
  Peptide Derived from Human Papillomavirus
FFKYSPTI

SEQ ID NO: 45596 - protein, 8 aa, Artificial Sequence
  Peptide Derived from Human Papillomavirus
FYHDISPI

SEQ ID NO: 45597 - protein, 10 aa, Artificial Sequence
  Peptide Derived from Human Papillomavirus
GYEEIPLQTF

SEQ ID NO: 45598 - protein, 9 aa, Artificial Sequence
  Peptide Derived from Human Papillomavirus
HFYHDISPI

SEQ ID NO: 45599 - protein, 10 aa, Artificial Sequence
  Peptide Derived from Human Papillomavirus
HYYLWPLYYF

SEQ ID NO: 45600 - protein, 11 aa, Artificial Sequence
  Peptide Derived from Human Papillomavirus
HYYLWPLYYFI

SEQ ID NO: 45601 - protein, 8 aa, Artificial Sequence
  Peptide Derived from Human Papillomavirus
IFLGGLGI

SEQ ID NO: 45602 - protein, 8 aa, Artificial Sequence
  Peptide Derived from Human Papillomavirus
LWPLYYFI

SEQ ID NO: 45603 - protein, 9 aa, Artificial Sequence
  Peptide Derived from Human Papillomavirus
MFTRSGTQI

SEQ ID NO: 45604 - protein, 8 aa, Artificial Sequence
  Peptide Derived from Human Papillomavirus
PYFFADGF

SEQ ID NO: 45605 - protein, 8 aa, Artificial Sequence
  Peptide Derived from Human Papillomavirus
QWSSLGIF

SEQ ID NO: 45606 - protein, 9 aa, Artificial Sequence
  Peptide Derived from Human Papillomavirus
QWSSLGIFL

SEQ ID NO: 45607 - protein, 11 aa, Artificial Sequence
  Peptide Derived from Human Papillomavirus
SFAFFKYSPTI

SEQ ID NO: 45608 - protein, 9 aa, Artificial Sequence
  Peptide Derived from Human Papillomavirus
SYSNVTVPL

SEQ ID NO: 45609 - protein, 8 aa, Artificial Sequence
  Peptide Derived from Human Papillomavirus
TFTGTSGF

SEQ ID NO: 45610 - protein, 10 aa, Artificial Sequence
  Peptide Derived from Human Papillomavirus
TFTGTSGFDI

SEQ ID NO: 45611 - protein, 10 aa, Artificial Sequence
  Peptide Derived from Human Papillomavirus
TMFTRSGTQI

SEQ ID NO: 45612 - protein, 9 aa, Artificial Sequence
  Peptide Derived from Human Papillomavirus
VYTGPDITL

SEQ ID NO: 45613 - protein, 9 aa, Artificial Sequence
  Peptide Derived from Human Papillomavirus
YYLWPLYYF

SEQ ID NO: 45614 - protein, 10 aa, Artificial Sequence
  Peptide Derived from Human Papillomavirus
YYLWPLYYFI

SEQ ID NO: 45615 - protein, 11 aa, Artificial Sequence
  Peptide Derived from Human Papillomavirus
AFLKSNSQAKI

SEQ ID NO: 45616 - protein, 9 aa, Artificial Sequence
  Peptide Derived from Human Papillomavirus
AMLGKFKEL

SEQ ID NO: 45617 - protein, 9 aa, Artificial Sequence
  Peptide Derived from Human Papillomavirus
CMLIQPPKL

SEQ ID NO: 45618 - protein, 9 aa, Artificial Sequence
  Peptide Derived from Human Papillomavirus
CWHYIDNYL

SEQ ID NO: 45619 - protein, 8 aa, Artificial Sequence
  Peptide Derived from Human Papillomavirus
DWRDIVKF

SEQ ID NO: 45620 - protein, 9 aa, Artificial Sequence
  Peptide Derived from Human Papillomavirus
DWRDIVKFL

SEQ ID NO: 45621 - protein, 8 aa, Artificial Sequence
  Peptide Derived from Human Papillomavirus
DYNISPRL

SEQ ID NO: 45622 - protein, 11 aa, Artificial Sequence
  Peptide Derived from Human Papillomavirus
DYNISPRLKAI

SEQ ID NO: 45623 - protein, 9 aa, Artificial Sequence
  Peptide Derived from Human Papillomavirus
EFVSFLSAL

SEQ ID NO: 45624 - protein, 11 aa, Artificial Sequence
  Peptide Derived from Human Papillomavirus
EFVSFLSALKL

SEQ ID NO: 45625 - protein, 9 aa, Artificial Sequence
  Peptide Derived from Human Papillomavirus
EWIERQTVL

SEQ ID NO: 45626 - protein, 9 aa, Artificial Sequence
  Peptide Derived from Human Papillomavirus
FFSRTWCRL

SEQ ID NO: 45627 - protein, 11 aa, Artificial Sequence
  Peptide Derived from Human Papillomavirus
FFSRTWCRLNL

SEQ ID NO: 45628 - protein, 8 aa, Artificial Sequence
  Peptide Derived from Human Papillomavirus
FMELIRPF

SEQ ID NO: 45629 - protein, 11 aa, Artificial Sequence
  Peptide Derived from Human Papillomavirus
FWLQPLADAKI

SEQ ID NO: 45630 - protein, 11 aa, Artificial Sequence
  Peptide Derived from Human Papillomavirus
GFKTLLQPYCL

SEQ ID NO: 45631 - protein, 11 aa, Artificial Sequence
  Peptide Derived from Human Papillomavirus
GMLDDATTPCW

SEQ ID NO: 45632 - protein, 8 aa, Artificial Sequence
  Peptide Derived from Human Papillomavirus
GMSLISFL

SEQ ID NO: 45633 - protein, 10 aa, Artificial Sequence
  Peptide Derived from Human Papillomavirus
GMVMLMLVRF

SEQ ID NO: 45634 - protein, 9 aa, Artificial Sequence
  Peptide Derived from Human Papillomavirus
GWFYVEAVI

SEQ ID NO: 45635 - protein, 11 aa, Artificial Sequence
  Peptide Derived from Human Papillomavirus
HYIDNYLRNAL

SEQ ID NO: 45636 - protein, 10 aa, Artificial Sequence
  Peptide Derived from Human Papillomavirus
KFKELYGVSF

SEQ ID NO: 45637 - protein, 8 aa, Artificial Sequence
  Peptide Derived from Human Papillomavirus
KFLRYQQI

SEQ ID NO: 45638 - protein, 10 aa, Artificial Sequence
  Peptide Derived from Human Papillomavirus
KFLRYQQIEF

SEQ ID NO: 45639 - protein, 10 aa, Artificial Sequence
  Peptide Derived from Human Papillomavirus
KYVGSPLSDI

SEQ ID NO: 45640 - protein, 9 aa, Artificial Sequence
  Peptide Derived from Human Papillomavirus
LMQLKCPPL

SEQ ID NO: 45641 - protein, 10 aa, Artificial Sequence
  Peptide Derived from Human Papillomavirus
LMQLKCPPLL

SEQ ID NO: 45642 - protein, 11 aa, Artificial Sequence
  Peptide Derived from Human Papillomavirus
LMQLKCPPLLI

SEQ ID NO: 45643 - protein, 8 aa, Artificial Sequence
  Peptide Derived from Human Papillomavirus
LYCHLQSL

SEQ ID NO: 45644 - protein, 9 aa, Artificial Sequence
  Peptide Derived from Human Papillomavirus
LYGVSFMEL

SEQ ID NO: 45645 - protein, 10 aa, Artificial Sequence
  Peptide Derived from Human Papillomavirus
LYGVSFMELI

SEQ ID NO: 45646 - protein, 11 aa, Artificial Sequence
  Peptide Derived from Human Papillomavirus
LYWYRTGMSNI

SEQ ID NO: 45647 - protein, 10 aa, Artificial Sequence
  Peptide Derived from Human Papillomavirus
NWKSFFSRTW

SEQ ID NO: 45648 - protein, 8 aa, Artificial Sequence
  Peptide Derived from Human Papillomavirus
PYCLYCHL

SEQ ID NO: 45649 - protein, 11 aa, Artificial Sequence
  Peptide Derived from Human Papillomavirus
PYCLYCHLQSL

SEQ ID NO: 45650 - protein, 10 aa, Artificial Sequence
  Peptide Derived from Human Papillomavirus
PYLHSRLVVF

SEQ ID NO: 45651 - protein, 8 aa, Artificial Sequence
  Peptide Derived from Human Papillomavirus
QMSMGQWI

SEQ ID NO: 45652 - protein, 9 aa, Artificial Sequence
  Peptide Derived from Human Papillomavirus
RFKCAKNRI

SEQ ID NO: 45653 - protein, 11 aa, Artificial Sequence
  Peptide Derived from Human Papillomavirus
RFKCAKNRITI

SEQ ID NO: 45654 - protein, 9 aa, Artificial Sequence
  Peptide Derived from Human Papillomavirus
RWPYLHSRL

SEQ ID NO: 45655 - protein, 10 aa, Artificial Sequence
  Peptide Derived from Human Papillomavirus
RYQQIEFVSF

SEQ ID NO: 45656 - protein, 11 aa, Artificial Sequence
  Peptide Derived from Human Papillomavirus
RYQQIEFVSFL

SEQ ID NO: 45657 - protein, 10 aa, Artificial Sequence
  Peptide Derived from Human Papillomavirus
SFFSRTWCRL

SEQ ID NO: 45658 - protein, 8 aa, Artificial Sequence
  Peptide Derived from Human Papillomavirus
SFLQGCII

SEQ ID NO: 45659 - protein, 8 aa, Artificial Sequence
  Peptide Derived from Human Papillomavirus
SFLSALKL

SEQ ID NO: 45660 - protein, 9 aa, Artificial Sequence
  Peptide Derived from Human Papillomavirus
SFLSALKLF

SEQ ID NO: 45661 - protein, 10 aa, Artificial Sequence
  Peptide Derived from Human Papillomavirus
SFLSALKLFL

SEQ ID NO: 45662 - protein, 9 aa, Artificial Sequence
  Peptide Derived from Human Papillomavirus
SFMELIRPF

SEQ ID NO: 45663 - protein, 9 aa, Artificial Sequence
  Peptide Derived from Human Papillomavirus
SFNDTTFDL

SEQ ID NO: 45664 - protein, 9 aa, Artificial Sequence
  Peptide Derived from Human Papillomavirus
SWGMVMLML

SEQ ID NO: 45665 - protein, 9 aa, Artificial Sequence
  Peptide Derived from Human Papillomavirus
SYANSKSHF

SEQ ID NO: 45666 - protein, 10 aa, Artificial Sequence
  Peptide Derived from Human Papillomavirus
SYANSKSHFW

SEQ ID NO: 45667 - protein, 11 aa, Artificial Sequence
  Peptide Derived from Human Papillomavirus
SYANSKSHFWL

SEQ ID NO: 45668 - protein, 8 aa, Artificial Sequence
  Peptide Derived from Human Papillomavirus
SYFGMSLI

SEQ ID NO: 45669 - protein, 10 aa, Artificial Sequence
  Peptide Derived from Human Papillomavirus
SYFGMSLISF

SEQ ID NO: 45670 - protein, 11 aa, Artificial Sequence
  Peptide Derived from Human Papillomavirus
SYFGMSLISFL

SEQ ID NO: 45671 - protein, 10 aa, Artificial Sequence
  Peptide Derived from Human Papillomavirus
TFDLSQMVQW

SEQ ID NO: 45672 - protein, 10 aa, Artificial Sequence
  Peptide Derived from Human Papillomavirus
TFKCVSGQNI

SEQ ID NO: 45673 - protein, 8 aa, Artificial Sequence
  Peptide Derived from Human Papillomavirus
TFPNPFPF

SEQ ID NO: 45674 - protein, 8 aa, Artificial Sequence
  Peptide Derived from Human Papillomavirus
VFTFPNPF

SEQ ID NO: 45675 - protein, 10 aa, Artificial Sequence
  Peptide Derived from Human Papillomavirus
VFTFPNPFPF

SEQ ID NO: 45676 - protein, 8 aa, Artificial Sequence
  Peptide Derived from Human Papillomavirus
VMLMLVRF

SEQ ID NO: 45677 - protein, 9 aa, Artificial Sequence
  Peptide Derived from Human Papillomavirus
VYELSDKNW

SEQ ID NO: 45678 - protein, 8 aa, Artificial Sequence
  Peptide Derived from Human Papillomavirus
VYGETPEW

SEQ ID NO: 45679 - protein, 9 aa, Artificial Sequence
  Peptide Derived from Human Papillomavirus
VYGETPEWI

SEQ ID NO: 45680 - protein, 8 aa, Artificial Sequence
  Peptide Derived from Human Papillomavirus
WFYVEAVI

SEQ ID NO: 45681 - protein, 9 aa, Artificial Sequence
  Peptide Derived from Human Papillomavirus
WYRTGMSNI

SEQ ID NO: 45682 - protein, 9 aa, Artificial Sequence
  Peptide Derived from Human Papillomavirus
YFGMSLISF

SEQ ID NO: 45683 - protein, 10 aa, Artificial Sequence
  Peptide Derived from Human Papillomavirus
YFGMSLISFL

SEQ ID NO: 45684 - protein, 10 aa, Artificial Sequence
  Peptide Derived from Human Papillomavirus
YWYRTGMSNI

SEQ ID NO: 45685 - protein, 8 aa, Artificial Sequence
  Peptide Derived from Human Papillomavirus
DFLNTVKI

SEQ ID NO: 45686 - protein, 9 aa, Artificial Sequence
  Peptide Derived from Human Papillomavirus
DWTMQQTSL

SEQ ID NO: 45687 - protein, 11 aa, Artificial Sequence
  Peptide Derived from Human Papillomavirus
DWTMQQTSLEL

SEQ ID NO: 45688 - protein, 8 aa, Artificial Sequence
  Peptide Derived from Human Papillomavirus
DYWKHIRL

SEQ ID NO: 45689 - protein, 8 aa, Artificial Sequence
  Peptide Derived from Human Papillomavirus
GYTVEVQF

SEQ ID NO: 45690 - protein, 9 aa, Artificial Sequence
  Peptide Derived from Human Papillomavirus
HYENDSKRL

SEQ ID NO: 45691 - protein, 8 aa, Artificial Sequence
  Peptide Derived from Human Papillomavirus
HYTNWKFI

SEQ ID NO: 45692 - protein, 10 aa, Artificial Sequence
  Peptide Derived from Human Papillomavirus
HYTNWKFIYL

SEQ ID NO: 45693 - protein, 9 aa, Artificial Sequence
  Peptide Derived from Human Papillomavirus
IYYVHEGHI

SEQ ID NO: 45694 - protein, 11 aa, Artificial Sequence
  Peptide Derived from Human Papillomavirus
KWEVHAGGQVI

SEQ ID NO: 45695 - protein, 8 aa, Artificial Sequence
  Peptide Derived from Human Papillomavirus
KYGTGKKW

SEQ ID NO: 45696 - protein, 10 aa, Artificial Sequence
  Peptide Derived from Human Papillomavirus
LMYKAREMGI

SEQ ID NO: 45697 - protein, 9 aa, Artificial Sequence
  Peptide Derived from Human Papillomavirus
LYEQVSSTW

SEQ ID NO: 45698 - protein, 11 aa, Artificial Sequence
  Peptide Derived from Human Papillomavirus
LYEQVSSTWHW

SEQ ID NO: 45699 - protein, 10 aa, Artificial Sequence
  Peptide Derived from Human Papillomavirus
LYLTAPTGCL

SEQ ID NO: 45700 - protein, 9 aa, Artificial Sequence
  Peptide Derived from Human Papillomavirus
MYKAREMGI

SEQ ID NO: 45701 - protein, 9 aa, Artificial Sequence
  Peptide Derived from Human Papillomavirus
NWKFIYLCI

SEQ ID NO: 45702 - protein, 10 aa, Artificial Sequence
  Peptide Derived from Human Papillomavirus
RYRLSKYKQL

SEQ ID NO: 45703 - protein, 9 aa, Artificial Sequence
  Peptide Derived from Human Papillomavirus
SFAGIVTKL

SEQ ID NO: 45704 - protein, 9 aa, Artificial Sequence
  Peptide Derived from Human Papillomavirus
TMHYTNWKF

SEQ ID NO: 45705 - protein, 10 aa, Artificial Sequence
  Peptide Derived from Human Papillomavirus
TMHYTNWKFI

SEQ ID NO: 45706 - protein, 9 aa, Artificial Sequence
  Peptide Derived from Human Papillomavirus
TMQQTSLEL

SEQ ID NO: 45707 - protein, 11 aa, Artificial Sequence
  Peptide Derived from Human Papillomavirus
TMQQTSLELYL

SEQ ID NO: 45708 - protein, 11 aa, Artificial Sequence
  Peptide Derived from Human Papillomavirus
TYISTSQRDDF

SEQ ID NO: 45709 - protein, 9 aa, Artificial Sequence
  Peptide Derived from Human Papillomavirus
VFSSDEISF

SEQ ID NO: 45710 - protein, 11 aa, Artificial Sequence
  Peptide Derived from Human Papillomavirus
YWKHIRLECVL

SEQ ID NO: 45711 - protein, 8 aa, Artificial Sequence
  Peptide Derived from Human Papillomavirus
YYVHEGHI

SEQ ID NO: 45712 - protein, 11 aa, Artificial Sequence
  Peptide Derived from Human Papillomavirus
YYVHEGHITYF

SEQ ID NO: 45713 - protein, 8 aa, Artificial Sequence
  Peptide Derived from Human Papillomavirus
CFCIYVVF

SEQ ID NO: 45714 - protein, 9 aa, Artificial Sequence
  Peptide Derived from Human Papillomavirus
CFCIYVVFI

SEQ ID NO: 45715 - protein, 11 aa, Artificial Sequence
  Peptide Derived from Human Papillomavirus
CFCIYVVFIYI

SEQ ID NO: 45716 - protein, 10 aa, Artificial Sequence
  Peptide Derived from Human Papillomavirus
CFCVLLFVCL

SEQ ID NO: 45717 - protein, 9 aa, Artificial Sequence
  Peptide Derived from Human Papillomavirus
CFLLCFCVL

SEQ ID NO: 45718 - protein, 10 aa, Artificial Sequence
  Peptide Derived from Human Papillomavirus
CFLLCFCVLL

SEQ ID NO: 45719 - protein, 11 aa, Artificial Sequence
  Peptide Derived from Human Papillomavirus
CFLLCFCVLLF

SEQ ID NO: 45720 - protein, 8 aa, Artificial Sequence
  Peptide Derived from Human Papillomavirus
IYIPLFVI

SEQ ID NO: 45721 - protein, 8 aa, Artificial Sequence
  Peptide Derived from Human Papillomavirus
IYVVFIYI

SEQ ID NO: 45722 - protein, 10 aa, Artificial Sequence
  Peptide Derived from Human Papillomavirus
IYVVFIYIPL

SEQ ID NO: 45723 - protein, 11 aa, Artificial Sequence
  Peptide Derived from Human Papillomavirus
IYVVFIYIPLF

SEQ ID NO: 45724 - protein, 10 aa, Artificial Sequence
  Peptide Derived from Human Papillomavirus
LFVCLVIRPL

SEQ ID NO: 45725 - protein, 10 aa, Artificial Sequence
  Peptide Derived from Human Papillomavirus
LFVIHTHASF

SEQ ID NO: 45726 - protein, 11 aa, Artificial Sequence
  Peptide Derived from Human Papillomavirus
LFVIHTHASFL

SEQ ID NO: 45727 - protein, 9 aa, Artificial Sequence
  Peptide Derived from Human Papillomavirus
LWVIATSPL

SEQ ID NO: 45728 - protein, 8 aa, Artificial Sequence
  Peptide Derived from Human Papillomavirus
VFIYIPLF

SEQ ID NO: 45729 - protein, 10 aa, Artificial Sequence
  Peptide Derived from Human Papillomavirus
VFIYIPLFVI

SEQ ID NO: 45730 - protein, 8 aa, Artificial Sequence
  Peptide Derived from Human Papillomavirus
VYATLLLL

SEQ ID NO: 45731 - protein, 9 aa, Artificial Sequence
  Peptide Derived from Human Papillomavirus
VYATLLLLI

SEQ ID NO: 45732 - protein, 11 aa, Artificial Sequence
  Peptide Derived from Human Papillomavirus
VYATLLLLIVI

SEQ ID NO: 45733 - protein, 9 aa, Artificial Sequence
  Peptide Derived from Human Papillomavirus
DFAFTDLTI

SEQ ID NO: 45734 - protein, 8 aa, Artificial Sequence
  Peptide Derived from Human Papillomavirus
FYSKVSEF

SEQ ID NO: 45735 - protein, 10 aa, Artificial Sequence
  Peptide Derived from Human Papillomavirus
FYSKVSEFRW

SEQ ID NO: 45736 - protein, 9 aa, Artificial Sequence
  Peptide Derived from Human Papillomavirus
RFHNIGGRW

SEQ ID NO: 45737 - protein, 9 aa, Artificial Sequence
  Peptide Derived from Human Papillomavirus
RFYSKVSEF

SEQ ID NO: 45738 - protein, 11 aa, Artificial Sequence
  Peptide Derived from Human Papillomavirus
RFYSKVSEFRW

SEQ ID NO: 45739 - protein, 10 aa, Artificial Sequence
  Peptide Derived from Human Papillomavirus
RWTGRCIACW

SEQ ID NO: 45740 - protein, 9 aa, Artificial Sequence
  Peptide Derived from Human Papillomavirus
RYSVYGTTL

SEQ ID NO: 45741 - protein, 9 aa, Artificial Sequence
  Peptide Derived from Human Papillomavirus
VYGTTLEKL

SEQ ID NO: 45742 - protein, 11 aa, Artificial Sequence
  Peptide Derived from Human Papillomavirus
WYRYSVYGTTL

SEQ ID NO: 45743 - protein, 10 aa, Artificial Sequence
  Peptide Derived from Human Papillomavirus
TFCCQCKSTL

SEQ ID NO: 45744 - protein, 9 aa, Artificial Sequence
  Peptide Derived from Human Papillomavirus
DYKQTQLCL

SEQ ID NO: 45745 - protein, 10 aa, Artificial Sequence
  Peptide Derived from Human Papillomavirus
DYKQTQLCLL

SEQ ID NO: 45746 - protein, 9 aa, Artificial Sequence
  Peptide Derived from Human Papillomavirus
DYVFWEVNL

SEQ ID NO: 45747 - protein, 8 aa, Artificial Sequence
  Peptide Derived from Human Papillomavirus
EFDLQFIF

SEQ ID NO: 45748 - protein, 10 aa, Artificial Sequence
  Peptide Derived from Human Papillomavirus
EFDLQFIFQL

SEQ ID NO: 45749 - protein, 9 aa, Artificial Sequence
  Peptide Derived from Human Papillomavirus
EYLRHGEEF

SEQ ID NO: 45750 - protein, 11 aa, Artificial Sequence
  Peptide Derived from Human Papillomavirus
EYLRHGEEFDL

SEQ ID NO: 45751 - protein, 8 aa, Artificial Sequence
  Peptide Derived from Human Papillomavirus
EYVTRTNI

SEQ ID NO: 45752 - protein, 10 aa, Artificial Sequence
  Peptide Derived from Human Papillomavirus
FFYLRREQMF

SEQ ID NO: 45753 - protein, 10 aa, Artificial Sequence
  Peptide Derived from Human Papillomavirus
FWEVNLKEKF

SEQ ID NO: 45754 - protein, 9 aa, Artificial Sequence
  Peptide Derived from Human Papillomavirus
FYLRREQMF

SEQ ID NO: 45755 - protein, 9 aa, Artificial Sequence
  Peptide Derived from Human Papillomavirus
FYNPETQRL

SEQ ID NO: 45756 - protein, 11 aa, Artificial Sequence
  Peptide Derived from Human Papillomavirus
FYNPETQRLVW

SEQ ID NO: 45757 - protein, 10 aa, Artificial Sequence
  Peptide Derived from Human Papillomavirus
GFGAMDFTAL

SEQ ID NO: 45758 - protein, 8 aa, Artificial Sequence
  Peptide Derived from Human Papillomavirus
GYRARPKF

SEQ ID NO: 45759 - protein, 9 aa, Artificial Sequence
  Peptide Derived from Human Papillomavirus
IFQLCKITL

SEQ ID NO: 45760 - protein, 10 aa, Artificial Sequence
  Peptide Derived from Human Papillomavirus
IYYHAGSARL

SEQ ID NO: 45761 - protein, 11 aa, Artificial Sequence
  Peptide Derived from Human Papillomavirus
IYYHAGSARLL

SEQ ID NO: 45762 - protein, 9 aa, Artificial Sequence
  Peptide Derived from Human Papillomavirus
KFGFPDTSF

SEQ ID NO: 45763 - protein, 9 aa, Artificial Sequence
  Peptide Derived from Human Papillomavirus
KFSADLDQF

SEQ ID NO: 45764 - protein, 11 aa, Artificial Sequence
  Peptide Derived from Human Papillomavirus
KFSADLDQFPL

SEQ ID NO: 45765 - protein, 11 aa, Artificial Sequence
  Peptide Derived from Human Papillomavirus
KMVAEPYGDTL

SEQ ID NO: 45766 - protein, 11 aa, Artificial Sequence
  Peptide Derived from Human Papillomavirus
LFFYLRREQMF

SEQ ID NO: 45767 - protein, 11 aa, Artificial Sequence
  Peptide Derived from Human Papillomavirus
LWRPSEATVYL

SEQ ID NO: 45768 - protein, 8 aa, Artificial Sequence
  Peptide Derived from Human Papillomavirus
NMSVCAAI

SEQ ID NO: 45769 - protein, 8 aa, Artificial Sequence
  Peptide Derived from Human Papillomavirus
PFKDYVFW

SEQ ID NO: 45770 - protein, 8 aa, Artificial Sequence
  Peptide Derived from Human Papillomavirus
PYGDTLFF

SEQ ID NO: 45771 - protein, 10 aa, Artificial Sequence
  Peptide Derived from Human Papillomavirus
PYGDTLFFYL

SEQ ID NO: 45772 - protein, 9 aa, Artificial Sequence
  Peptide Derived from Human Papillomavirus
QFIFQLCKI

SEQ ID NO: 45773 - protein, 11 aa, Artificial Sequence
  Peptide Derived from Human Papillomavirus
QFIFQLCKITL

SEQ ID NO: 45774 - protein, 8 aa, Artificial Sequence
  Peptide Derived from Human Papillomavirus
QFPLGRKF

SEQ ID NO: 45775 - protein, 9 aa, Artificial Sequence
  Peptide Derived from Human Papillomavirus
QFPLGRKFL

SEQ ID NO: 45776 - protein, 10 aa, Artificial Sequence
  Peptide Derived from Human Papillomavirus
QFPLGRKFLL

SEQ ID NO: 45777 - protein, 8 aa, Artificial Sequence
  Peptide Derived from Human Papillomavirus
QMFVRHFF

SEQ ID NO: 45778 - protein, 9 aa, Artificial Sequence
  Peptide Derived from Human Papillomavirus
QYRVFRVRL

SEQ ID NO: 45779 - protein, 8 aa, Artificial Sequence
  Peptide Derived from Human Papillomavirus
RFVTSQAI

SEQ ID NO: 45780 - protein, 10 aa, Artificial Sequence
  Peptide Derived from Human Papillomavirus
SFYNPETQRL

SEQ ID NO: 45781 - protein, 9 aa, Artificial Sequence
  Peptide Derived from Human Papillomavirus
SMDYKQTQL

SEQ ID NO: 45782 - protein, 11 aa, Artificial Sequence
  Peptide Derived from Human Papillomavirus
SMDYKQTQLCL

SEQ ID NO: 45783 - protein, 10 aa, Artificial Sequence
  Peptide Derived from Human Papillomavirus
SMNPAILEDW

SEQ ID NO: 45784 - protein, 9 aa, Artificial Sequence
  Peptide Derived from Human Papillomavirus
SMVTSDAQI

SEQ ID NO: 45785 - protein, 10 aa, Artificial Sequence
  Peptide Derived from Human Papillomavirus
SMVTSDAQIF

SEQ ID NO: 45786 - protein, 11 aa, Artificial Sequence
  Peptide Derived from Human Papillomavirus
TFKSSNFKEYL

SEQ ID NO: 45787 - protein, 10 aa, Artificial Sequence
  Peptide Derived from Human Papillomavirus
TYIHSMNPAI

SEQ ID NO: 45788 - protein, 11 aa, Artificial Sequence
  Peptide Derived from Human Papillomavirus
TYIHSMNPAIL

SEQ ID NO: 45789 - protein, 10 aa, Artificial Sequence
  Peptide Derived from Human Papillomavirus
TYRFVTSQAI

SEQ ID NO: 45790 - protein, 11 aa, Artificial Sequence
  Peptide Derived from Human Papillomavirus
VFWEVNLKEKF

SEQ ID NO: 45791 - protein, 9 aa, Artificial Sequence
  Peptide Derived from Human Papillomavirus
YYHAGSARL

SEQ ID NO: 45792 - protein, 10 aa, Artificial Sequence
  Peptide Derived from Human Papillomavirus
YYHAGSARLL

SEQ ID NO: 45793 - protein, 11 aa, Artificial Sequence
  Peptide Derived from Human Papillomavirus
AYETVNAEESL

SEQ ID NO: 45794 - protein, 11 aa, Artificial Sequence
  Peptide Derived from Human Papillomavirus
AYVPTNTTVPL

SEQ ID NO: 45795 - protein, 8 aa, Artificial Sequence
  Peptide Derived from Human Papillomavirus
DFLDIIAL

SEQ ID NO: 45796 - protein, 11 aa, Artificial Sequence
  Peptide Derived from Human Papillomavirus
DFYLHPSYYML

SEQ ID NO: 45797 - protein, 10 aa, Artificial Sequence
  Peptide Derived from Human Papillomavirus
FYLHPSYYML

SEQ ID NO: 45798 - protein, 9 aa, Artificial Sequence
  Peptide Derived from Human Papillomavirus
HYYYDISSI

SEQ ID NO: 45799 - protein, 9 aa, Artificial Sequence
  Peptide Derived from Human Papillomavirus
IFSGPDVPI

SEQ ID NO: 45800 - protein, 8 aa, Artificial Sequence
  Peptide Derived from Human Papillomavirus
IFVDGGDF

SEQ ID NO: 45801 - protein, 10 aa, Artificial Sequence
  Peptide Derived from Human Papillomavirus
IFVDGGDFYL

SEQ ID NO: 45802 - protein, 10 aa, Artificial Sequence
  Peptide Derived from Human Papillomavirus
LYDIYADTDF

SEQ ID NO: 45803 - protein, 10 aa, Artificial Sequence
  Peptide Derived from Human Papillomavirus
LYFSNTSHNI

SEQ ID NO: 45804 - protein, 10 aa, Artificial Sequence
  Peptide Derived from Human Papillomavirus
NYEEIPMDTF

SEQ ID NO: 45805 - protein, 11 aa, Artificial Sequence
  Peptide Derived from Human Papillomavirus
NYEEIPMDTFI

SEQ ID NO: 45806 - protein, 8 aa, Artificial Sequence
  Peptide Derived from Human Papillomavirus
RYGSMGVF

SEQ ID NO: 45807 - protein, 9 aa, Artificial Sequence
  Peptide Derived from Human Papillomavirus
RYGSMGVFF

SEQ ID NO: 45808 - protein, 11 aa, Artificial Sequence
  Peptide Derived from Human Papillomavirus
RYSRLGNKQTL

SEQ ID NO: 45809 - protein, 9 aa, Artificial Sequence
  Peptide Derived from Human Papillomavirus
SMGVFFGGL

SEQ ID NO: 45810 - protein, 11 aa, Artificial Sequence
  Peptide Derived from Human Papillomavirus
SMGVFFGGLGI

SEQ ID NO: 45811 - protein, 11 aa, Artificial Sequence
  Peptide Derived from Human Papillomavirus
TFIVSTNNENI

SEQ ID NO: 45812 - protein, 9 aa, Artificial Sequence
  Peptide Derived from Human Papillomavirus
TFLSAPKQL

SEQ ID NO: 45813 - protein, 10 aa, Artificial Sequence
  Peptide Derived from Human Papillomavirus
TFLSAPKQLI

SEQ ID NO: 45814 - protein, 8 aa, Artificial Sequence
  Peptide Derived from Human Papillomavirus
TFTDPSVL

SEQ ID NO: 45815 - protein, 8 aa, Artificial Sequence
  Peptide Derived from Human Papillomavirus
VFFGGLGI

SEQ ID NO: 45816 - protein, 9 aa, Artificial Sequence
  Peptide Derived from Human Papillomavirus
YFSNTSHNI

SEQ ID NO: 45817 - protein, 8 aa, Artificial Sequence
  Peptide Derived from Human Papillomavirus
YYYDISSI

SEQ ID NO: 45818 - protein, 9 aa, Artificial Sequence
  Peptide Derived from Human Papillomavirus
AFKKFLKGI

SEQ ID NO: 45819 - protein, 9 aa, Artificial Sequence
  Peptide Derived from Human Papillomavirus
AFLGAFKKF

SEQ ID NO: 45820 - protein, 10 aa, Artificial Sequence
  Peptide Derived from Human Papillomavirus
AFLGAFKKFL

SEQ ID NO: 45821 - protein, 11 aa, Artificial Sequence
  Peptide Derived from Human Papillomavirus
AFLKSNSQAKI

SEQ ID NO: 45822 - protein, 9 aa, Artificial Sequence
  Peptide Derived from Human Papillomavirus
AYGISFMEL

SEQ ID NO: 45823 - protein, 9 aa, Artificial Sequence
  Peptide Derived from Human Papillomavirus
CMVIEPPKL

SEQ ID NO: 45824 - protein, 9 aa, Artificial Sequence
  Peptide Derived from Human Papillomavirus
DWCITGYGI

SEQ ID NO: 45825 - protein, 11 aa, Artificial Sequence
  Peptide Derived from Human Papillomavirus
EFIDDSMENSI

SEQ ID NO: 45826 - protein, 8 aa, Artificial Sequence
  Peptide Derived from Human Papillomavirus
EFKNPFPF

SEQ ID NO: 45827 - protein, 9 aa, Artificial Sequence
  Peptide Derived from Human Papillomavirus
EFTAFLGAF

SEQ ID NO: 45828 - protein, 11 aa, Artificial Sequence
  Peptide Derived from Human Papillomavirus
EMVQWAYDNEL

SEQ ID NO: 45829 - protein, 9 aa, Artificial Sequence
  Peptide Derived from Human Papillomavirus
EWIDRLTVL

SEQ ID NO: 45830 - protein, 9 aa, Artificial Sequence
  Peptide Derived from Human Papillomavirus
FFSRTWCKL

SEQ ID NO: 45831 - protein, 11 aa, Artificial Sequence
  Peptide Derived from Human Papillomavirus
FFSRTWCKLDL

SEQ ID NO: 45832 - protein, 8 aa, Artificial Sequence
  Peptide Derived from Human Papillomavirus
FMELVRPF

SEQ ID NO: 45833 - protein, 11 aa, Artificial Sequence
  Peptide Derived from Human Papillomavirus
FWLQPLSDAKI

SEQ ID NO: 45834 - protein, 8 aa, Artificial Sequence
  Peptide Derived from Human Papillomavirus
GMGCTGWF

SEQ ID NO: 45835 - protein, 9 aa, Artificial Sequence
  Peptide Derived from Human Papillomavirus
GMIDDVTPI

SEQ ID NO: 45836 - protein, 11 aa, Artificial Sequence
  Peptide Derived from Human Papillomavirus
GMIDDVTPISW

SEQ ID NO: 45837 - protein, 8 aa, Artificial Sequence
  Peptide Derived from Human Papillomavirus
GMSLIQFL

SEQ ID NO: 45838 - protein, 9 aa, Artificial Sequence
  Peptide Derived from Human Papillomavirus
GWFEVEAVI

SEQ ID NO: 45839 - protein, 10 aa, Artificial Sequence
  Peptide Derived from Human Papillomavirus
IFDLSEMVQW

SEQ ID NO: 45840 - protein, 8 aa, Artificial Sequence
  Peptide Derived from Human Papillomavirus
KFKEAYGI

SEQ ID NO: 45841 - protein, 10 aa, Artificial Sequence
  Peptide Derived from Human Papillomavirus
KFKEAYGISF

SEQ ID NO: 45842 - protein, 8 aa, Artificial Sequence
  Peptide Derived from Human Papillomavirus
KMSIGQWI

SEQ ID NO: 45843 - protein, 11 aa, Artificial Sequence
  Peptide Derived from Human Papillomavirus
LFNIQEGEDDL

SEQ ID NO: 45844 - protein, 8 aa, Artificial Sequence
  Peptide Derived from Human Papillomavirus
LMSNLLSI

SEQ ID NO: 45845 - protein, 10 aa, Artificial Sequence
  Peptide Derived from Human Papillomavirus
LYKFKEAYGI

SEQ ID NO: 45846 - protein, 8 aa, Artificial Sequence
  Peptide Derived from Human Papillomavirus
LYTHLQCL

SEQ ID NO: 45847 - protein, 11 aa, Artificial Sequence
  Peptide Derived from Human Papillomavirus
LYWFRTAMSNI

SEQ ID NO: 45848 - protein, 10 aa, Artificial Sequence
  Peptide Derived from Human Papillomavirus
NWKSFFSRTW

SEQ ID NO: 45849 - protein, 8 aa, Artificial Sequence
  Peptide Derived from Human Papillomavirus
NWRPIVQL

SEQ ID NO: 45850 - protein, 9 aa, Artificial Sequence
  Peptide Derived from Human Papillomavirus
NWRPIVQLL

SEQ ID NO: 45851 - protein, 10 aa, Artificial Sequence
  Peptide Derived from Human Papillomavirus
PYLHSRLTVF

SEQ ID NO: 45852 - protein, 8 aa, Artificial Sequence
  Peptide Derived from Human Papillomavirus
QFLKGCVI

SEQ ID NO: 45853 - protein, 8 aa, Artificial Sequence
  Peptide Derived from Human Papillomavirus
QWAYDNEL

SEQ ID NO: 45854 - protein, 9 aa, Artificial Sequence
  Peptide Derived from Human Papillomavirus
RFRCSKNRL

SEQ ID NO: 45855 - protein, 9 aa, Artificial Sequence
  Peptide Derived from Human Papillomavirus
RWPYLHSRL

SEQ ID NO: 45856 - protein, 10 aa, Artificial Sequence
  Peptide Derived from Human Papillomavirus
RYQNIEFTAF

SEQ ID NO: 45857 - protein, 11 aa, Artificial Sequence
  Peptide Derived from Human Papillomavirus
RYQNIEFTAFL

SEQ ID NO: 45858 - protein, 10 aa, Artificial Sequence
  Peptide Derived from Human Papillomavirus
SFFSRTWCKL

SEQ ID NO: 45859 - protein, 9 aa, Artificial Sequence
  Peptide Derived from Human Papillomavirus
SFMELVRPF

SEQ ID NO: 45860 - protein, 9 aa, Artificial Sequence
  Peptide Derived from Human Papillomavirus
SFNDNIFDL

SEQ ID NO: 45861 - protein, 8 aa, Artificial Sequence
  Peptide Derived from Human Papillomavirus
SYFGMSLI

SEQ ID NO: 45862 - protein, 10 aa, Artificial Sequence
  Peptide Derived from Human Papillomavirus
SYFGMSLIQF

SEQ ID NO: 45863 - protein, 11 aa, Artificial Sequence
  Peptide Derived from Human Papillomavirus
SYFGMSLIQFL

SEQ ID NO: 45864 - protein, 8 aa, Artificial Sequence
  Peptide Derived from Human Papillomavirus
TWCKLDLI

SEQ ID NO: 45865 - protein, 11 aa, Artificial Sequence
  Peptide Derived from Human Papillomavirus
TYIDDYMRNAL

SEQ ID NO: 45866 - protein, 10 aa, Artificial Sequence
  Peptide Derived from Human Papillomavirus
TYRKRKIDEL

SEQ ID NO: 45867 - protein, 8 aa, Artificial Sequence
  Peptide Derived from Human Papillomavirus
VFEFKNPF

SEQ ID NO: 45868 - protein, 10 aa, Artificial Sequence
  Peptide Derived from Human Papillomavirus
VFEFKNPFPF

SEQ ID NO: 45869 - protein, 9 aa, Artificial Sequence
  Peptide Derived from Human Papillomavirus
VYAINDENW

SEQ ID NO: 45870 - protein, 8 aa, Artificial Sequence
  Peptide Derived from Human Papillomavirus
WFEVEAVI

SEQ ID NO: 45871 - protein, 9 aa, Artificial Sequence
  Peptide Derived from Human Papillomavirus
WFRTAMSNI

SEQ ID NO: 45872 - protein, 9 aa, Artificial Sequence
  Peptide Derived from Human Papillomavirus
YFGMSLIQF

SEQ ID NO: 45873 - protein, 10 aa, Artificial Sequence
  Peptide Derived from Human Papillomavirus
YFGMSLIQFL

SEQ ID NO: 45874 - protein, 11 aa, Artificial Sequence
  Peptide Derived from Human Papillomavirus
YMRNALDGNEI

SEQ ID NO: 45875 - protein, 10 aa, Artificial Sequence
  Peptide Derived from Human Papillomavirus
YWFRTAMSNI

SEQ ID NO: 45876 - protein, 11 aa, Artificial Sequence
  Peptide Derived from Human Papillomavirus
AFQVIELQMAL

SEQ ID NO: 45877 - protein, 8 aa, Artificial Sequence
  Peptide Derived from Human Papillomavirus
DYIGMYYI

SEQ ID NO: 45878 - protein, 8 aa, Artificial Sequence
  Peptide Derived from Human Papillomavirus
DYTNWGEI

SEQ ID NO: 45879 - protein, 10 aa, Artificial Sequence
  Peptide Derived from Human Papillomavirus
DYTNWGEIYI

SEQ ID NO: 45880 - protein, 11 aa, Artificial Sequence
  Peptide Derived from Human Papillomavirus
DYTNWGEIYII

SEQ ID NO: 45881 - protein, 11 aa, Artificial Sequence
  Peptide Derived from Human Papillomavirus
HWKLIRMECAL

SEQ ID NO: 45882 - protein, 8 aa, Artificial Sequence
  Peptide Derived from Human Papillomavirus
KYSKTQMW

SEQ ID NO: 45883 - protein, 8 aa, Artificial Sequence
  Peptide Derived from Human Papillomavirus
LFCADPAL

SEQ ID NO: 45884 - protein, 9 aa, Artificial Sequence
  Peptide Derived from Human Papillomavirus
LYEADKTDL

SEQ ID NO: 45885 - protein, 9 aa, Artificial Sequence
  Peptide Derived from Human Papillomavirus
LYSSMSSTW

SEQ ID NO: 45886 - protein, 11 aa, Artificial Sequence
  Peptide Derived from Human Papillomavirus
LYSSMSSTWHW

SEQ ID NO: 45887 - protein, 9 aa, Artificial Sequence
  Peptide Derived from Human Papillomavirus
LYTAKQMGF

SEQ ID NO: 45888 - protein, 8 aa, Artificial Sequence
  Peptide Derived from Human Papillomavirus
MFLGTVKI

SEQ ID NO: 45889 - protein, 11 aa, Artificial Sequence
  Peptide Derived from Human Papillomavirus
MWEVHVGGQVI

SEQ ID NO: 45890 - protein, 8 aa, Artificial Sequence
  Peptide Derived from Human Papillomavirus
NWGEIYII

SEQ ID NO: 45891 - protein, 9 aa, Artificial Sequence
  Peptide Derived from Human Papillomavirus
QMFLGTVKI

SEQ ID NO: 45892 - protein, 9 aa, Artificial Sequence
  Peptide Derived from Human Papillomavirus
QWTLQQTSL

SEQ ID NO: 45893 - protein, 9 aa, Artificial Sequence
  Peptide Derived from Human Papillomavirus
QYSTSQWTL

SEQ ID NO: 45894 - protein, 10 aa, Artificial Sequence
  Peptide Derived from Human Papillomavirus
RYRLKPYKEL

SEQ ID NO: 45895 - protein, 8 aa, Artificial Sequence
  Peptide Derived from Human Papillomavirus
SMSSTWHW

SEQ ID NO: 45896 - protein, 11 aa, Artificial Sequence
  Peptide Derived from Human Papillomavirus
TFVTEQQQQMF

SEQ ID NO: 45897 - protein, 10 aa, Artificial Sequence
  Peptide Derived from Human Papillomavirus
TMDYTNWGEI

SEQ ID NO: 45898 - protein, 10 aa, Artificial Sequence
  Peptide Derived from Human Papillomavirus
TMVTGKVDYI

SEQ ID NO: 45899 - protein, 10 aa, Artificial Sequence
  Peptide Derived from Human Papillomavirus
VWLCEPPKCF

SEQ ID NO: 45900 - protein, 11 aa, Artificial Sequence
  Peptide Derived from Human Papillomavirus
YYIHNCEKVYF

SEQ ID NO: 45901 - protein, 8 aa, Artificial Sequence
  Peptide Derived from Human Papillomavirus
AWLLVLVL

SEQ ID NO: 45902 - protein, 9 aa, Artificial Sequence
  Peptide Derived from Human Papillomavirus
AWLLVLVLL

SEQ ID NO: 45903 - protein, 10 aa, Artificial Sequence
  Peptide Derived from Human Papillomavirus
AWLLVLVLLL

SEQ ID NO: 45904 - protein, 11 aa, Artificial Sequence
  Peptide Derived from Human Papillomavirus
AWLLVLVLLLW

SEQ ID NO: 45905 - protein, 8 aa, Artificial Sequence
  Peptide Derived from Human Papillomavirus
CFILFLCL

SEQ ID NO: 45906 - protein, 10 aa, Artificial Sequence
  Peptide Derived from Human Papillomavirus
CFILFLCLSL

SEQ ID NO: 45907 - protein, 11 aa, Artificial Sequence
  Peptide Derived from Human Papillomavirus
CFILFLCLSLL

SEQ ID NO: 45908 - protein, 8 aa, Artificial Sequence
  Peptide Derived from Human Papillomavirus
CYLLFLYL

SEQ ID NO: 45909 - protein, 8 aa, Artificial Sequence
  Peptide Derived from Human Papillomavirus
FFCYLLFL

SEQ ID NO: 45910 - protein, 10 aa, Artificial Sequence
  Peptide Derived from Human Papillomavirus
FFCYLLFLYL

SEQ ID NO: 45911 - protein, 8 aa, Artificial Sequence
  Peptide Derived from Human Papillomavirus
IFFCYLLF

SEQ ID NO: 45912 - protein, 9 aa, Artificial Sequence
  Peptide Derived from Human Papillomavirus
IFFCYLLFL

SEQ ID NO: 45913 - protein, 11 aa, Artificial Sequence
  Peptide Derived from Human Papillomavirus
IFFCYLLFLYL

SEQ ID NO: 45914 - protein, 8 aa, Artificial Sequence
  Peptide Derived from Human Papillomavirus
IFVFVLCF

SEQ ID NO: 45915 - protein, 9 aa, Artificial Sequence
  Peptide Derived from Human Papillomavirus
IFVFVLCFI

SEQ ID NO: 45916 - protein, 10 aa, Artificial Sequence
  Peptide Derived from Human Papillomavirus
IFVFVLCFIL

SEQ ID NO: 45917 - protein, 11 aa, Artificial Sequence
  Peptide Derived from Human Papillomavirus
IFVFVLCFILF

SEQ ID NO: 45918 - protein, 8 aa, Artificial Sequence
  Peptide Derived from Human Papillomavirus
LFLCLSLL

SEQ ID NO: 45919 - protein, 9 aa, Artificial Sequence
  Peptide Derived from Human Papillomavirus
LFLCLSLLL

SEQ ID NO: 45920 - protein, 10 aa, Artificial Sequence
  Peptide Derived from Human Papillomavirus
LFLYLPMMCI

SEQ ID NO: 45921 - protein, 9 aa, Artificial Sequence
  Peptide Derived from Human Papillomavirus
LWVFVGSPL

SEQ ID NO: 45922 - protein, 11 aa, Artificial Sequence
  Peptide Derived from Human Papillomavirus
LWVFVGSPLKI

SEQ ID NO: 45923 - protein, 8 aa, Artificial Sequence
  Peptide Derived from Human Papillomavirus
LYLPMMCI

SEQ ID NO: 45924 - protein, 10 aa, Artificial Sequence
  Peptide Derived from Human Papillomavirus
LYLPMMCINF

SEQ ID NO: 45925 - protein, 8 aa, Artificial Sequence
  Peptide Derived from Human Papillomavirus
TYAWLLVL

SEQ ID NO: 45926 - protein, 10 aa, Artificial Sequence
  Peptide Derived from Human Papillomavirus
TYAWLLVLVL

SEQ ID NO: 45927 - protein, 11 aa, Artificial Sequence
  Peptide Derived from Human Papillomavirus
TYAWLLVLVLL

SEQ ID NO: 45928 - protein, 9 aa, Artificial Sequence
  Peptide Derived from Human Papillomavirus
VFVGSPLKI

SEQ ID NO: 45929 - protein, 10 aa, Artificial Sequence
  Peptide Derived from Human Papillomavirus
VFVGSPLKIF

SEQ ID NO: 45930 - protein, 11 aa, Artificial Sequence
  Peptide Derived from Human Papillomavirus
VFVGSPLKIFF

SEQ ID NO: 45931 - protein, 8 aa, Artificial Sequence
  Peptide Derived from Human Papillomavirus
VFVLCFIL

SEQ ID NO: 45932 - protein, 9 aa, Artificial Sequence
  Peptide Derived from Human Papillomavirus
VFVLCFILF

SEQ ID NO: 45933 - protein, 10 aa, Artificial Sequence
  Peptide Derived from Human Papillomavirus
VFVLCFILFL

SEQ ID NO: 45934 - protein, 11 aa, Artificial Sequence
  Peptide Derived from Human Papillomavirus
CWRSRRRETAL

SEQ ID NO: 45935 - protein, 11 aa, Artificial Sequence
  Peptide Derived from Human Papillomavirus
HYNYSVYGNTL

SEQ ID NO: 45936 - protein, 9 aa, Artificial Sequence
  Peptide Derived from Human Papillomavirus
NYSVYGNTL

SEQ ID NO: 45937 - protein, 9 aa, Artificial Sequence
  Peptide Derived from Human Papillomavirus
PFGICKLCL

SEQ ID NO: 45938 - protein, 11 aa, Artificial Sequence
  Peptide Derived from Human Papillomavirus
PFGICKLCLRF

SEQ ID NO: 45939 - protein, 9 aa, Artificial Sequence
  Peptide Derived from Human Papillomavirus
RFHNISGRW

SEQ ID NO: 45940 - protein, 10 aa, Artificial Sequence
  Peptide Derived from Human Papillomavirus
RWAGRCAACW

SEQ ID NO: 45941 - protein, 9 aa, Artificial Sequence
  Peptide Derived from Human Papillomavirus
VYDFAFADL

SEQ ID NO: 45942 - protein, 8 aa, Artificial Sequence
  Peptide Derived from Human Papillomavirus
VYREGNPF

SEQ ID NO: 45943 - protein, 10 aa, Artificial Sequence
  Peptide Derived from Human Papillomavirus
VYREGNPFGI

SEQ ID NO: 45944 - protein, 8 aa, Artificial Sequence
  Peptide Derived from Human Papillomavirus
LYPEPTDL

SEQ ID NO: 45945 - protein, 10 aa, Artificial Sequence
  Peptide Derived from Human Papillomavirus
AMNPDILEDW

SEQ ID NO: 45946 - protein, 9 aa, Artificial Sequence
  Peptide Derived from Human Papillomavirus
DYKQTQLCL

SEQ ID NO: 45947 - protein, 10 aa, Artificial Sequence
  Peptide Derived from Human Papillomavirus
DYKQTQLCLL

SEQ ID NO: 45948 - protein, 8 aa, Artificial Sequence
  Peptide Derived from Human Papillomavirus
EYDLQFVF

SEQ ID NO: 45949 - protein, 10 aa, Artificial Sequence
  Peptide Derived from Human Papillomavirus
EYDLQFVFQL

SEQ ID NO: 45950 - protein, 11 aa, Artificial Sequence
  Peptide Derived from Human Papillomavirus
EYIRHVEEYDL

SEQ ID NO: 45951 - protein, 8 aa, Artificial Sequence
  Peptide Derived from Human Papillomavirus
EYVSRTSI

SEQ ID NO: 45952 - protein, 10 aa, Artificial Sequence
  Peptide Derived from Human Papillomavirus
FFFLRREQMF

SEQ ID NO: 45953 - protein, 9 aa, Artificial Sequence
  Peptide Derived from Human Papillomavirus
FFLRREQMF

SEQ ID NO: 45954 - protein, 8 aa, Artificial Sequence
  Peptide Derived from Human Papillomavirus
FFNRAGTL

SEQ ID NO: 45955 - protein, 10 aa, Artificial Sequence
  Peptide Derived from Human Papillomavirus
FWEVDLKEKF

SEQ ID NO: 45956 - protein, 9 aa, Artificial Sequence
  Peptide Derived from Human Papillomavirus
FYNPDTQRL

SEQ ID NO: 45957 - protein, 11 aa, Artificial Sequence
  Peptide Derived from Human Papillomavirus
FYNPDTQRLVW

SEQ ID NO: 45958 - protein, 10 aa, Artificial Sequence
  Peptide Derived from Human Papillomavirus
GFGCMDFKTL

SEQ ID NO: 45959 - protein, 9 aa, Artificial Sequence
  Peptide Derived from Human Papillomavirus
HFFNRAGTL

SEQ ID NO: 45960 - protein, 10 aa, Artificial Sequence
  Peptide Derived from Human Papillomavirus
IYYYAGSSRL

SEQ ID NO: 45961 - protein, 11 aa, Artificial Sequence
  Peptide Derived from Human Papillomavirus
IYYYAGSSRLL

SEQ ID NO: 45962 - protein, 9 aa, Artificial Sequence
  Peptide Derived from Human Papillomavirus
KFGFPDTSF

SEQ ID NO: 45963 - protein, 8 aa, Artificial Sequence
  Peptide Derived from Human Papillomavirus
KFLLQAGL

SEQ ID NO: 45964 - protein, 9 aa, Artificial Sequence
  Peptide Derived from Human Papillomavirus
KFSADLDQF

SEQ ID NO: 45965 - protein, 11 aa, Artificial Sequence
  Peptide Derived from Human Papillomavirus
KFSADLDQFPL

SEQ ID NO: 45966 - protein, 11 aa, Artificial Sequence
  Peptide Derived from Human Papillomavirus
KMTSEPYGDSL

SEQ ID NO: 45967 - protein, 9 aa, Artificial Sequence
  Peptide Derived from Human Papillomavirus
KYTFWEVDL

SEQ ID NO: 45968 - protein, 11 aa, Artificial Sequence
  Peptide Derived from Human Papillomavirus
LFFFLRREQMF

SEQ ID NO: 45969 - protein, 8 aa, Artificial Sequence
  Peptide Derived from Human Papillomavirus
LFNKPYWL

SEQ ID NO: 45970 - protein, 8 aa, Artificial Sequence
  Peptide Derived from Human Papillomavirus
PYGDSLFF

SEQ ID NO: 45971 - protein, 9 aa, Artificial Sequence
  Peptide Derived from Human Papillomavirus
PYGDSLFFF

SEQ ID NO: 45972 - protein, 10 aa, Artificial Sequence
  Peptide Derived from Human Papillomavirus
PYGDSLFFFL

SEQ ID NO: 45973 - protein, 8 aa, Artificial Sequence
  Peptide Derived from Human Papillomavirus
QFPLGRKF

SEQ ID NO: 45974 - protein, 9 aa, Artificial Sequence
  Peptide Derived from Human Papillomavirus
QFPLGRKFL

SEQ ID NO: 45975 - protein, 10 aa, Artificial Sequence
  Peptide Derived from Human Papillomavirus
QFPLGRKFLL

SEQ ID NO: 45976 - protein, 11 aa, Artificial Sequence
  Peptide Derived from Human Papillomavirus
QFVFQLCKVTL

SEQ ID NO: 45977 - protein, 8 aa, Artificial Sequence
  Peptide Derived from Human Papillomavirus
QMFVRHFF

SEQ ID NO: 45978 - protein, 9 aa, Artificial Sequence
  Peptide Derived from Human Papillomavirus
QYRVFRVRL

SEQ ID NO: 45979 - protein, 8 aa, Artificial Sequence
  Peptide Derived from Human Papillomavirus
RFVTSQAI

SEQ ID NO: 45980 - protein, 10 aa, Artificial Sequence
  Peptide Derived from Human Papillomavirus
SFYNPDTQRL

SEQ ID NO: 45981 - protein, 9 aa, Artificial Sequence
  Peptide Derived from Human Papillomavirus
SMDYKQTQL

SEQ ID NO: 45982 - protein, 11 aa, Artificial Sequence
  Peptide Derived from Human Papillomavirus
SMDYKQTQLCL

SEQ ID NO: 45983 - protein, 9 aa, Artificial Sequence
  Peptide Derived from Human Papillomavirus
SMVTSESQL

SEQ ID NO: 45984 - protein, 10 aa, Artificial Sequence
  Peptide Derived from Human Papillomavirus
SMVTSESQLF

SEQ ID NO: 45985 - protein, 11 aa, Artificial Sequence
  Peptide Derived from Human Papillomavirus
TFWEVDLKEKF

SEQ ID NO: 45986 - protein, 10 aa, Artificial Sequence
  Peptide Derived from Human Papillomavirus
TYIHAMNPDI

SEQ ID NO: 45987 - protein, 11 aa, Artificial Sequence
  Peptide Derived from Human Papillomavirus
TYIHAMNPDIL

SEQ ID NO: 45988 - protein, 11 aa, Artificial Sequence
  Peptide Derived from Human Papillomavirus
TYKNENFKEYI

SEQ ID NO: 45989 - protein, 10 aa, Artificial Sequence
  Peptide Derived from Human Papillomavirus
TYRFVTSQAI

SEQ ID NO: 45990 - protein, 9 aa, Artificial Sequence
  Peptide Derived from Human Papillomavirus
VFQLCKVTL

SEQ ID NO: 45991 - protein, 9 aa, Artificial Sequence
  Peptide Derived from Human Papillomavirus
VWACVGLEI

SEQ ID NO: 45992 - protein, 11 aa, Artificial Sequence
  Peptide Derived from Human Papillomavirus
VWRPSEATVYL

SEQ ID NO: 45993 - protein, 8 aa, Artificial Sequence
  Peptide Derived from Human Papillomavirus
YYAGSSRL

SEQ ID NO: 45994 - protein, 9 aa, Artificial Sequence
  Peptide Derived from Human Papillomavirus
YYAGSSRLL

SEQ ID NO: 45995 - protein, 9 aa, Artificial Sequence
  Peptide Derived from Human Papillomavirus
YYYAGSSRL

SEQ ID NO: 45996 - protein, 10 aa, Artificial Sequence
  Peptide Derived from Human Papillomavirus
YYYAGSSRLL

SEQ ID NO: 45997 - protein, 11 aa, Artificial Sequence
  Peptide Derived from Human Papillomavirus
AFESFDPEDTL

SEQ ID NO: 45998 - protein, 9 aa, Artificial Sequence
  Peptide Derived from Human Papillomavirus
AFLTSPHKL

SEQ ID NO: 45999 - protein, 10 aa, Artificial Sequence
  Peptide Derived from Human Papillomavirus
AFLTSPHKLI

SEQ ID NO: 46000 - protein, 8 aa, Artificial Sequence
  Peptide Derived from Human Papillomavirus
DFLDIIAL

SEQ ID NO: 46001 - protein, 9 aa, Artificial Sequence
  Peptide Derived from Human Papillomavirus
DFVLHPSYF

SEQ ID NO: 46002 - protein, 10 aa, Artificial Sequence
  Peptide Derived from Human Papillomavirus
DFVLHPSYFI

SEQ ID NO: 46003 - protein, 11 aa, Artificial Sequence
  Peptide Derived from Human Papillomavirus
DFVLHPSYFIL

SEQ ID NO: 46004 - protein, 9 aa, Artificial Sequence
  Peptide Derived from Human Papillomavirus
HYYQDLSPI

SEQ ID NO: 46005 - protein, 8 aa, Artificial Sequence
  Peptide Derived from Human Papillomavirus
KYGSLGVF

SEQ ID NO: 46006 - protein, 9 aa, Artificial Sequence
  Peptide Derived from Human Papillomavirus
KYGSLGVFF

SEQ ID NO: 46007 - protein, 8 aa, Artificial Sequence
  Peptide Derived from Human Papillomavirus
LFPTSSPF

SEQ ID NO: 46008 - protein, 11 aa, Artificial Sequence
  Peptide Derived from Human Papillomavirus
LFPTSSPFVPI

SEQ ID NO: 46009 - protein, 8 aa, Artificial Sequence
  Peptide Derived from Human Papillomavirus
PFFPFDTI

SEQ ID NO: 46010 - protein, 8 aa, Artificial Sequence
  Peptide Derived from Human Papillomavirus
PFVPISPF

SEQ ID NO: 46011 - protein, 9 aa, Artificial Sequence
  Peptide Derived from Human Papillomavirus
PFVPISPFF

SEQ ID NO: 46012 - protein, 11 aa, Artificial Sequence
  Peptide Derived from Human Papillomavirus
PFVPISPFFPF

SEQ ID NO: 46013 - protein, 9 aa, Artificial Sequence
  Peptide Derived from Human Papillomavirus
PMQHSYSTF

SEQ ID NO: 46014 - protein, 11 aa, Artificial Sequence
  Peptide Derived from Human Papillomavirus
RFSRVGQKATL

SEQ ID NO: 46015 - protein, 8 aa, Artificial Sequence
  Peptide Derived from Human Papillomavirus
SFDPEDTL

SEQ ID NO: 46016 - protein, 10 aa, Artificial Sequence
  Peptide Derived from Human Papillomavirus
SFDPEDTLQF

SEQ ID NO: 46017 - protein, 10 aa, Artificial Sequence
  Peptide Derived from Human Papillomavirus
SYENIPMDTF

SEQ ID NO: 46018 - protein, 8 aa, Artificial Sequence
  Peptide Derived from Human Papillomavirus
SYSINDGL

SEQ ID NO: 46019 - protein, 8 aa, Artificial Sequence
  Peptide Derived from Human Papillomavirus
TFTEPSVL

SEQ ID NO: 46020 - protein, 10 aa, Artificial Sequence
  Peptide Derived from Human Papillomavirus
TYDNPAFESF

SEQ ID NO: 46021 - protein, 8 aa, Artificial Sequence
  Peptide Derived from Human Papillomavirus
VFFGGLGI

SEQ ID NO: 46022 - protein, 11 aa, Artificial Sequence
  Peptide Derived from Human Papillomavirus
VMSGPDIPSPL

SEQ ID NO: 46023 - protein, 11 aa, Artificial Sequence
  Peptide Derived from Human Papillomavirus
YFILRRRRKRF

SEQ ID NO: 46024 - protein, 8 aa, Artificial Sequence
  Peptide Derived from Human Papillomavirus
YYQDLSPI

SEQ ID NO: 46025 - protein, 11 aa, Artificial Sequence
  Peptide Derived from Human Papillomavirus
YYQDLSPIVPL

SEQ ID NO: 46026 - protein, 9 aa, Artificial Sequence
  Peptide Derived from Human Papillomavirus
AMLAVFKDI

SEQ ID NO: 46027 - protein, 11 aa, Artificial Sequence
  Peptide Derived from Human Papillomavirus
AMLDDATHTCW

SEQ ID NO: 46028 - protein, 10 aa, Artificial Sequence
  Peptide Derived from Human Papillomavirus
CFFERTWSRL

SEQ ID NO: 46029 - protein, 9 aa, Artificial Sequence
  Peptide Derived from Human Papillomavirus
CMLIEPPKL

SEQ ID NO: 46030 - protein, 9 aa, Artificial Sequence
  Peptide Derived from Human Papillomavirus
DFIDTQLSI

SEQ ID NO: 46031 - protein, 9 aa, Artificial Sequence
  Peptide Derived from Human Papillomavirus
DMAFQYAQL

SEQ ID NO: 46032 - protein, 10 aa, Artificial Sequence
  Peptide Derived from Human Papillomavirus
DMVDFIDTQL

SEQ ID NO: 46033 - protein, 11 aa, Artificial Sequence
  Peptide Derived from Human Papillomavirus
DMVQWAFDNDL

SEQ ID NO: 46034 - protein, 8 aa, Artificial Sequence
  Peptide Derived from Human Papillomavirus
DWRPIVQF

SEQ ID NO: 46035 - protein, 9 aa, Artificial Sequence
  Peptide Derived from Human Papillomavirus
DWRPIVQFL

SEQ ID NO: 46036 - protein, 9 aa, Artificial Sequence
  Peptide Derived from Human Papillomavirus
EFISFLRAL

SEQ ID NO: 46037 - protein, 8 aa, Artificial Sequence
  Peptide Derived from Human Papillomavirus
EWIQRLTI

SEQ ID NO: 46038 - protein, 9 aa, Artificial Sequence
  Peptide Derived from Human Papillomavirus
EWIQRLTII

SEQ ID NO: 46039 - protein, 9 aa, Artificial Sequence
  Peptide Derived from Human Papillomavirus
FFERTWSRL

SEQ ID NO: 46040 - protein, 11 aa, Artificial Sequence
  Peptide Derived from Human Papillomavirus
FFERTWSRLDL

SEQ ID NO: 46041 - protein, 11 aa, Artificial Sequence
  Peptide Derived from Human Papillomavirus
GFKTLIKPATL

SEQ ID NO: 46042 - protein, 8 aa, Artificial Sequence
  Peptide Derived from Human Papillomavirus
GMSFIHFL

SEQ ID NO: 46043 - protein, 8 aa, Artificial Sequence
  Peptide Derived from Human Papillomavirus
GWFFVETI

SEQ ID NO: 46044 - protein, 8 aa, Artificial Sequence
  Peptide Derived from Human Papillomavirus
HFLQGAII

SEQ ID NO: 46045 - protein, 10 aa, Artificial Sequence
  Peptide Derived from Human Papillomavirus
HFLQGAIISF

SEQ ID NO: 46046 - protein, 9 aa, Artificial Sequence
  Peptide Derived from Human Papillomavirus
IYGLSFTDL

SEQ ID NO: 46047 - protein, 9 aa, Artificial Sequence
  Peptide Derived from Human Papillomavirus
KWGVLILAL

SEQ ID NO: 46048 - protein, 10 aa, Artificial Sequence
  Peptide Derived from Human Papillomavirus
KWGVLILALL

SEQ ID NO: 46049 - protein, 8 aa, Artificial Sequence
  Peptide Derived from Human Papillomavirus
LYAHIQCL

SEQ ID NO: 46050 - protein, 8 aa, Artificial Sequence
  Peptide Derived from Human Papillomavirus
LYWYRTGI

SEQ ID NO: 46051 - protein, 11 aa, Artificial Sequence
  Peptide Derived from Human Papillomavirus
LYWYRTGISNI

SEQ ID NO: 46052 - protein, 10 aa, Artificial Sequence
  Peptide Derived from Human Papillomavirus
NFDLSDMVQW

SEQ ID NO: 46053 - protein, 10 aa, Artificial Sequence
  Peptide Derived from Human Papillomavirus
NWKCFFERTW

SEQ ID NO: 46054 - protein, 10 aa, Artificial Sequence
  Peptide Derived from Human Papillomavirus
PYLESRVTVF

SEQ ID NO: 46055 - protein, 10 aa, Artificial Sequence
  Peptide Derived from Human Papillomavirus
QFLRYQGVEF

SEQ ID NO: 46056 - protein, 11 aa, Artificial Sequence
  Peptide Derived from Human Papillomavirus
QFLRYQGVEFI

SEQ ID NO: 46057 - protein, 8 aa, Artificial Sequence
  Peptide Derived from Human Papillomavirus
QMNMSQWI

SEQ ID NO: 46058 - protein, 8 aa, Artificial Sequence
  Peptide Derived from Human Papillomavirus
QWAFDNDL

SEQ ID NO: 46059 - protein, 10 aa, Artificial Sequence
  Peptide Derived from Human Papillomavirus
QWIKYRCSKI

SEQ ID NO: 46060 - protein, 9 aa, Artificial Sequence
  Peptide Derived from Human Papillomavirus
RYKCGKNRL

SEQ ID NO: 46061 - protein, 8 aa, Artificial Sequence
  Peptide Derived from Human Papillomavirus
RYQGVEFI

SEQ ID NO: 46062 - protein, 10 aa, Artificial Sequence
  Peptide Derived from Human Papillomavirus
RYQGVEFISF

SEQ ID NO: 46063 - protein, 11 aa, Artificial Sequence
  Peptide Derived from Human Papillomavirus
RYQGVEFISFL

SEQ ID NO: 46064 - protein, 10 aa, Artificial Sequence
  Peptide Derived from Human Papillomavirus
SFIHFLQGAI

SEQ ID NO: 46065 - protein, 11 aa, Artificial Sequence
  Peptide Derived from Human Papillomavirus
SFIHFLQGAII

SEQ ID NO: 46066 - protein, 9 aa, Artificial Sequence
  Peptide Derived from Human Papillomavirus
SFLRALKEF

SEQ ID NO: 46067 - protein, 10 aa, Artificial Sequence
  Peptide Derived from Human Papillomavirus
SFLRALKEFL

SEQ ID NO: 46068 - protein, 9 aa, Artificial Sequence
  Peptide Derived from Human Papillomavirus
SFTDLVRNF

SEQ ID NO: 46069 - protein, 9 aa, Artificial Sequence
  Peptide Derived from Human Papillomavirus
SFVNSNSHF

SEQ ID NO: 46070 - protein, 10 aa, Artificial Sequence
  Peptide Derived from Human Papillomavirus
SFVNSNSHFW

SEQ ID NO: 46071 - protein, 11 aa, Artificial Sequence
  Peptide Derived from Human Papillomavirus
SFVNSNSHFWL

SEQ ID NO: 46072 - protein, 8 aa, Artificial Sequence
  Peptide Derived from Human Papillomavirus
SYFGMSFI

SEQ ID NO: 46073 - protein, 10 aa, Artificial Sequence
  Peptide Derived from Human Papillomavirus
SYFGMSFIHF

SEQ ID NO: 46074 - protein, 11 aa, Artificial Sequence
  Peptide Derived from Human Papillomavirus
SYFGMSFIHFL

SEQ ID NO: 46075 - protein, 8 aa, Artificial Sequence
  Peptide Derived from Human Papillomavirus
TFPHAFPF

SEQ ID NO: 46076 - protein, 11 aa, Artificial Sequence
  Peptide Derived from Human Papillomavirus
TYFDNYMRNAL

SEQ ID NO: 46077 - protein, 8 aa, Artificial Sequence
  Peptide Derived from Human Papillomavirus
VFKDIYGL

SEQ ID NO: 46078 - protein, 10 aa, Artificial Sequence
  Peptide Derived from Human Papillomavirus
VFKDIYGLSF

SEQ ID NO: 46079 - protein, 8 aa, Artificial Sequence
  Peptide Derived from Human Papillomavirus
VFTFPHAF

SEQ ID NO: 46080 - protein, 10 aa, Artificial Sequence
  Peptide Derived from Human Papillomavirus
VFTFPHAFPF

SEQ ID NO: 46081 - protein, 9 aa, Artificial Sequence
  Peptide Derived from Human Papillomavirus
VYEINDKNW

SEQ ID NO: 46082 - protein, 9 aa, Artificial Sequence
  Peptide Derived from Human Papillomavirus
WYRTGISNI

SEQ ID NO: 46083 - protein, 10 aa, Artificial Sequence
  Peptide Derived from Human Papillomavirus
YFDNYMRNAL

SEQ ID NO: 46084 - protein, 9 aa, Artificial Sequence
  Peptide Derived from Human Papillomavirus
YFGMSFIHF

SEQ ID NO: 46085 - protein, 10 aa, Artificial Sequence
  Peptide Derived from Human Papillomavirus
YFGMSFIHFL

SEQ ID NO: 46086 - protein, 11 aa, Artificial Sequence
  Peptide Derived from Human Papillomavirus
YMRNALDGNPI

SEQ ID NO: 46087 - protein, 10 aa, Artificial Sequence
  Peptide Derived from Human Papillomavirus
YWYRTGISNI

SEQ ID NO: 46088 - protein, 10 aa, Artificial Sequence
  Peptide Derived from Human Papillomavirus
CMNYVVWDSI

SEQ ID NO: 46089 - protein, 11 aa, Artificial Sequence
  Peptide Derived from Human Papillomavirus
EWTLQDTCEEL

SEQ ID NO: 46090 - protein, 11 aa, Artificial Sequence
  Peptide Derived from Human Papillomavirus
HWTGCNKNTGI

SEQ ID NO: 46091 - protein, 9 aa, Artificial Sequence
  Peptide Derived from Human Papillomavirus
HYENDSKDI

SEQ ID NO: 46092 - protein, 9 aa, Artificial Sequence
  Peptide Derived from Human Papillomavirus
HYSEISSTW

SEQ ID NO: 46093 - protein, 11 aa, Artificial Sequence
  Peptide Derived from Human Papillomavirus
HYSEISSTWHW

SEQ ID NO: 46094 - protein, 9 aa, Artificial Sequence
  Peptide Derived from Human Papillomavirus
IYYITETGI

SEQ ID NO: 46095 - protein, 10 aa, Artificial Sequence
  Peptide Derived from Human Papillomavirus
IYYITETGIW

SEQ ID NO: 46096 - protein, 9 aa, Artificial Sequence
  Peptide Derived from Human Papillomavirus
KMQTPKESL

SEQ ID NO: 46097 - protein, 9 aa, Artificial Sequence
  Peptide Derived from Human Papillomavirus
KYADHYSEI

SEQ ID NO: 46098 - protein, 8 aa, Artificial Sequence
  Peptide Derived from Human Papillomavirus
KYGNSNTW

SEQ ID NO: 46099 - protein, 9 aa, Artificial Sequence
  Peptide Derived from Human Papillomavirus
KYNNEEWTL

SEQ ID NO: 46100 - protein, 9 aa, Artificial Sequence
  Peptide Derived from Human Papillomavirus
LFTAREHGI

SEQ ID NO: 46101 - protein, 10 aa, Artificial Sequence
  Peptide Derived from Human Papillomavirus
LWNTEPSQCF

SEQ ID NO: 46102 - protein, 8 aa, Artificial Sequence
  Peptide Derived from Human Papillomavirus
NYVVWDSI

SEQ ID NO: 46103 - protein, 11 aa, Artificial Sequence
  Peptide Derived from Human Papillomavirus
NYVVWDSIYYI

SEQ ID NO: 46104 - protein, 8 aa, Artificial Sequence
  Peptide Derived from Human Papillomavirus
SYWGVYYI

SEQ ID NO: 46105 - protein, 8 aa, Artificial Sequence
  Peptide Derived from Human Papillomavirus
SYWQLIRL

SEQ ID NO: 46106 - protein, 8 aa, Artificial Sequence
  Peptide Derived from Human Papillomavirus
TFLDVVTI

SEQ ID NO: 46107 - protein, 11 aa, Artificial Sequence
  Peptide Derived from Human Papillomavirus
TWEVQYGGNVI

SEQ ID NO: 46108 - protein, 11 aa, Artificial Sequence
  Peptide Derived from Human Papillomavirus
TYNSEVQRNTF

SEQ ID NO: 46109 - protein, 8 aa, Artificial Sequence
  Peptide Derived from Human Papillomavirus
VWDSIYYI

SEQ ID NO: 46110 - protein, 11 aa, Artificial Sequence
  Peptide Derived from Human Papillomavirus
YWQLIRLENAI

SEQ ID NO: 46111 - protein, 8 aa, Artificial Sequence
  Peptide Derived from Human Papillomavirus
YYITETGI

SEQ ID NO: 46112 - protein, 9 aa, Artificial Sequence
  Peptide Derived from Human Papillomavirus
YYITETGIW

SEQ ID NO: 46113 - protein, 9 aa, Artificial Sequence
  Peptide Derived from Human Papillomavirus
AYAACHKCI

SEQ ID NO: 46114 - protein, 11 aa, Artificial Sequence
  Peptide Derived from Human Papillomavirus
AYAACHKCIDF

SEQ ID NO: 46115 - protein, 9 aa, Artificial Sequence
  Peptide Derived from Human Papillomavirus
DFYSRIREL

SEQ ID NO: 46116 - protein, 8 aa, Artificial Sequence
  Peptide Derived from Human Papillomavirus
FYSRIREL

SEQ ID NO: 46117 - protein, 9 aa, Artificial Sequence
  Peptide Derived from Human Papillomavirus
LFIVYRDCI

SEQ ID NO: 46118 - protein, 9 aa, Artificial Sequence
  Peptide Derived from Human Papillomavirus
LYNLLIRCL

SEQ ID NO: 46119 - protein, 11 aa, Artificial Sequence
  Peptide Derived from Human Papillomavirus
PYKLPDLCTEL

SEQ ID NO: 46120 - protein, 8 aa, Artificial Sequence
  Peptide Derived from Human Papillomavirus
QFAFKDLF

SEQ ID NO: 46121 - protein, 9 aa, Artificial Sequence
  Peptide Derived from Human Papillomavirus
QFAFKDLFI

SEQ ID NO: 46122 - protein, 9 aa, Artificial Sequence
  Peptide Derived from Human Papillomavirus
VYGETLEKI

SEQ ID NO: 46123 - protein, 9 aa, Artificial Sequence
  Peptide Derived from Human Papillomavirus
VYQFAFKDL

SEQ ID NO: 46124 - protein, 10 aa, Artificial Sequence
  Peptide Derived from Human Papillomavirus
VYQFAFKDLF

SEQ ID NO: 46125 - protein, 11 aa, Artificial Sequence
  Peptide Derived from Human Papillomavirus
VYQFAFKDLFI

SEQ ID NO: 46126 - protein, 11 aa, Artificial Sequence
  Peptide Derived from Human Papillomavirus
YYSNSVYGETL

SEQ ID NO: 46127 - protein, 8 aa, Artificial Sequence
  Peptide Derived from Human Papillomavirus
LFLSTLSF

SEQ ID NO: 46128 - protein, 11 aa, Artificial Sequence
  Peptide Derived from Human Papillomavirus
AYQYRVFRVAL

SEQ ID NO: 46129 - protein, 9 aa, Artificial Sequence
  Peptide Derived from Human Papillomavirus
DYKQTQLCI

SEQ ID NO: 46130 - protein, 10 aa, Artificial Sequence
  Peptide Derived from Human Papillomavirus
DYKQTQLCIL

SEQ ID NO: 46131 - protein, 8 aa, Artificial Sequence
  Peptide Derived from Human Papillomavirus
DYVSRTSI

SEQ ID NO: 46132 - protein, 9 aa, Artificial Sequence
  Peptide Derived from Human Papillomavirus
DYVSRTSIF

SEQ ID NO: 46133 - protein, 8 aa, Artificial Sequence
  Peptide Derived from Human Papillomavirus
EYDLQFIF

SEQ ID NO: 46134 - protein, 10 aa, Artificial Sequence
  Peptide Derived from Human Papillomavirus
EYDLQFIFQL

SEQ ID NO: 46135 - protein, 9 aa, Artificial Sequence
  Peptide Derived from Human Papillomavirus
FFCLRREQL

SEQ ID NO: 46136 - protein, 10 aa, Artificial Sequence
  Peptide Derived from Human Papillomavirus
FFCLRREQLF

SEQ ID NO: 46137 - protein, 10 aa, Artificial Sequence
  Peptide Derived from Human Papillomavirus
FWTVDLKEKF

SEQ ID NO: 46138 - protein, 9 aa, Artificial Sequence
  Peptide Derived from Human Papillomavirus
FYHAGSSRL

SEQ ID NO: 46139 - protein, 10 aa, Artificial Sequence
  Peptide Derived from Human Papillomavirus
FYHAGSSRLL

SEQ ID NO: 46140 - protein, 10 aa, Artificial Sequence
  Peptide Derived from Human Papillomavirus
GMEIGRGQPL

SEQ ID NO: 46141 - protein, 10 aa, Artificial Sequence
  Peptide Derived from Human Papillomavirus
GYGAMDFSTL

SEQ ID NO: 46142 - protein, 11 aa, Artificial Sequence
  Peptide Derived from Human Papillomavirus
HYSRHVEEYDL

SEQ ID NO: 46143 - protein, 9 aa, Artificial Sequence
  Peptide Derived from Human Papillomavirus
IFLKNVNVF

SEQ ID NO: 46144 - protein, 11 aa, Artificial Sequence
  Peptide Derived from Human Papillomavirus
IFLKNVNVFPI

SEQ ID NO: 46145 - protein, 8 aa, Artificial Sequence
  Peptide Derived from Human Papillomavirus
IFLQMALW

SEQ ID NO: 46146 - protein, 9 aa, Artificial Sequence
  Peptide Derived from Human Papillomavirus
IFQLCTITL

SEQ ID NO: 46147 - protein, 10 aa, Artificial Sequence
  Peptide Derived from Human Papillomavirus
IFYHAGSSRL

SEQ ID NO: 46148 - protein, 11 aa, Artificial Sequence
  Peptide Derived from Human Papillomavirus
IFYHAGSSRLL

SEQ ID NO: 46149 - protein, 8 aa, Artificial Sequence
  Peptide Derived from Human Papillomavirus
IYGHGIII

SEQ ID NO: 46150 - protein, 9 aa, Artificial Sequence
  Peptide Derived from Human Papillomavirus
IYGHGIIIF

SEQ ID NO: 46151 - protein, 10 aa, Artificial Sequence
  Peptide Derived from Human Papillomavirus
IYGHGIIIFL

SEQ ID NO: 46152 - protein, 9 aa, Artificial Sequence
  Peptide Derived from Human Papillomavirus
IYNPETQRL

SEQ ID NO: 46153 - protein, 11 aa, Artificial Sequence
  Peptide Derived from Human Papillomavirus
IYNPETQRLVW

SEQ ID NO: 46154 - protein, 9 aa, Artificial Sequence
  Peptide Derived from Human Papillomavirus
KFGLPDSTI

SEQ ID NO: 46155 - protein, 8 aa, Artificial Sequence
  Peptide Derived from Human Papillomavirus
KFLVQAGL

SEQ ID NO: 46156 - protein, 11 aa, Artificial Sequence
  Peptide Derived from Human Papillomavirus
KFSSDLDQYPL

SEQ ID NO: 46157 - protein, 11 aa, Artificial Sequence
  Peptide Derived from Human Papillomavirus
KFWTVDLKEKF

SEQ ID NO: 46158 - protein, 8 aa, Artificial Sequence
  Peptide Derived from Human Papillomavirus
LFNKPYWL

SEQ ID NO: 46159 - protein, 11 aa, Artificial Sequence
  Peptide Derived from Human Papillomavirus
LWRPSDSTVYL

SEQ ID NO: 46160 - protein, 10 aa, Artificial Sequence
  Peptide Derived from Human Papillomavirus
MFFCLRREQL

SEQ ID NO: 46161 - protein, 11 aa, Artificial Sequence
  Peptide Derived from Human Papillomavirus
MFFCLRREQLF

SEQ ID NO: 46162 - protein, 8 aa, Artificial Sequence
  Peptide Derived from Human Papillomavirus
PYDKLKFW

SEQ ID NO: 46163 - protein, 8 aa, Artificial Sequence
  Peptide Derived from Human Papillomavirus
PYGDSMFF

SEQ ID NO: 46164 - protein, 10 aa, Artificial Sequence
  Peptide Derived from Human Papillomavirus
PYGDSMFFCL

SEQ ID NO: 46165 - protein, 9 aa, Artificial Sequence
  Peptide Derived from Human Papillomavirus
QFIFQLCTI

SEQ ID NO: 46166 - protein, 11 aa, Artificial Sequence
  Peptide Derived from Human Papillomavirus
QFIFQLCTITL

SEQ ID NO: 46167 - protein, 8 aa, Artificial Sequence
  Peptide Derived from Human Papillomavirus
QYPLGRKF

SEQ ID NO: 46168 - protein, 9 aa, Artificial Sequence
  Peptide Derived from Human Papillomavirus
QYPLGRKFL

SEQ ID NO: 46169 - protein, 9 aa, Artificial Sequence
  Peptide Derived from Human Papillomavirus
QYRVFRVAL

SEQ ID NO: 46170 - protein, 11 aa, Artificial Sequence
  Peptide Derived from Human Papillomavirus
SMFFCLRREQL

SEQ ID NO: 46171 - protein, 10 aa, Artificial Sequence
  Peptide Derived from Human Papillomavirus
SMNSSILENW

SEQ ID NO: 46172 - protein, 10 aa, Artificial Sequence
  Peptide Derived from Human Papillomavirus
SYIHSMNSSI

SEQ ID NO: 46173 - protein, 11 aa, Artificial Sequence
  Peptide Derived from Human Papillomavirus
SYIHSMNSSIL

SEQ ID NO: 46174 - protein, 10 aa, Artificial Sequence
  Peptide Derived from Human Papillomavirus
VFPIFLQMAL

SEQ ID NO: 46175 - protein, 11 aa, Artificial Sequence
  Peptide Derived from Human Papillomavirus
VFPIFLQMALW

SEQ ID NO: 46176 - protein, 10 aa, Artificial Sequence
  Peptide Derived from Human Papillomavirus
VMGDTVPTDL

SEQ ID NO: 46177 - protein, 9 aa, Artificial Sequence
  Peptide Derived from Human Papillomavirus
VWACVGMEI

SEQ ID NO: 46178 - protein, 10 aa, Artificial Sequence
  Peptide Derived from Human Papillomavirus
VYSPSPSGSI

SEQ ID NO: 46179 - protein, 8 aa, Artificial Sequence
  Peptide Derived from Human Papillomavirus
AFSDPSII

SEQ ID NO: 46180 - protein, 9 aa, Artificial Sequence
  Peptide Derived from Human Papillomavirus
AYEPLDTTL

SEQ ID NO: 46181 - protein, 11 aa, Artificial Sequence
  Peptide Derived from Human Papillomavirus
AYEPLDTTLSF

SEQ ID NO: 46182 - protein, 8 aa, Artificial Sequence
  Peptide Derived from Human Papillomavirus
DFMDIIRL

SEQ ID NO: 46183 - protein, 8 aa, Artificial Sequence
  Peptide Derived from Human Papillomavirus
FYHDISPI

SEQ ID NO: 46184 - protein, 10 aa, Artificial Sequence
  Peptide Derived from Human Papillomavirus
GYEEIPLQTF

SEQ ID NO: 46185 - protein, 9 aa, Artificial Sequence
  Peptide Derived from Human Papillomavirus
HFYHDISPI

SEQ ID NO: 46186 - protein, 8 aa, Artificial Sequence
  Peptide Derived from Human Papillomavirus
IFLGGLGI

SEQ ID NO: 46187 - protein, 8 aa, Artificial Sequence
  Peptide Derived from Human Papillomavirus
IYTGPDII

SEQ ID NO: 46188 - protein, 9 aa, Artificial Sequence
  Peptide Derived from Human Papillomavirus
IYTGPDIIL

SEQ ID NO: 46189 - protein, 8 aa, Artificial Sequence
  Peptide Derived from Human Papillomavirus
LFDVYADF

SEQ ID NO: 46190 - protein, 8 aa, Artificial Sequence
  Peptide Derived from Human Papillomavirus
LWPWYYYF

SEQ ID NO: 46191 - protein, 9 aa, Artificial Sequence
  Peptide Derived from Human Papillomavirus
MFTRSGKQI

SEQ ID NO: 46192 - protein, 8 aa, Artificial Sequence
  Peptide Derived from Human Papillomavirus
PYFFADGF

SEQ ID NO: 46193 - protein, 9 aa, Artificial Sequence
  Peptide Derived from Human Papillomavirus
QFLTHPSSL

SEQ ID NO: 46194 - protein, 8 aa, Artificial Sequence
  Peptide Derived from Human Papillomavirus
QWSSLGIF

SEQ ID NO: 46195 - protein, 9 aa, Artificial Sequence
  Peptide Derived from Human Papillomavirus
QWSSLGIFL

SEQ ID NO: 46196 - protein, 11 aa, Artificial Sequence
  Peptide Derived from Human Papillomavirus
QYYLWPWYYYF

SEQ ID NO: 46197 - protein, 9 aa, Artificial Sequence
  Peptide Derived from Human Papillomavirus
SFTYPKYSL

SEQ ID NO: 46198 - protein, 9 aa, Artificial Sequence
  Peptide Derived from Human Papillomavirus
SYSNVTVPL

SEQ ID NO: 46199 - protein, 10 aa, Artificial Sequence
  Peptide Derived from Human Papillomavirus
TFDNPAYEPL

SEQ ID NO: 46200 - protein, 8 aa, Artificial Sequence
  Peptide Derived from Human Papillomavirus
TFTGTSGF

SEQ ID NO: 46201 - protein, 10 aa, Artificial Sequence
  Peptide Derived from Human Papillomavirus
TFTGTSGFEI

SEQ ID NO: 46202 - protein, 10 aa, Artificial Sequence
  Peptide Derived from Human Papillomavirus
TMFTRSGKQI

SEQ ID NO: 46203 - protein, 9 aa, Artificial Sequence
  Peptide Derived from Human Papillomavirus
YFPKKRKRI

SEQ ID NO: 46204 - protein, 10 aa, Artificial Sequence
  Peptide Derived from Human Papillomavirus
YYFPKKRKRI

SEQ ID NO: 46205 - protein, 10 aa, Artificial Sequence
  Peptide Derived from Human Papillomavirus
YYLWPWYYYF

SEQ ID NO: 46206 - protein, 11 aa, Artificial Sequence
  Peptide Derived from Human Papillomavirus
YYYFPKKRKRI

SEQ ID NO: 46207 - protein, 9 aa, Artificial Sequence
  Peptide Derived from Human Papillomavirus
CFKKEGQHI

SEQ ID NO: 46208 - protein, 10 aa, Artificial Sequence
  Peptide Derived from Human Papillomavirus
CMQYVAWKYI

SEQ ID NO: 46209 - protein, 9 aa, Artificial Sequence
  Peptide Derived from Human Papillomavirus
DFEQEAKKF

SEQ ID NO: 46210 - protein, 11 aa, Artificial Sequence
  Peptide Derived from Human Papillomavirus
EWTLRDTCEEL

SEQ ID NO: 46211 - protein, 11 aa, Artificial Sequence
  Peptide Derived from Human Papillomavirus
IWEVHMENESI

SEQ ID NO: 46212 - protein, 11 aa, Artificial Sequence
  Peptide Derived from Human Papillomavirus
IYKDETQRNSF

SEQ ID NO: 46213 - protein, 9 aa, Artificial Sequence
  Peptide Derived from Human Papillomavirus
IYNNEEWTL

SEQ ID NO: 46214 - protein, 9 aa, Artificial Sequence
  Peptide Derived from Human Papillomavirus
IYYNGDCGW

SEQ ID NO: 46215 - protein, 8 aa, Artificial Sequence
  Peptide Derived from Human Papillomavirus
KFGCKNIW

SEQ ID NO: 46216 - protein, 11 aa, Artificial Sequence
  Peptide Derived from Human Papillomavirus
KYIYYNGDCGW

SEQ ID NO: 46217 - protein, 11 aa, Artificial Sequence
  Peptide Derived from Human Papillomavirus
LFVDVTSTYHW

SEQ ID NO: 46218 - protein, 10 aa, Artificial Sequence
  Peptide Derived from Human Papillomavirus
LWLTEPKKCF

SEQ ID NO: 46219 - protein, 8 aa, Artificial Sequence
  Peptide Derived from Human Papillomavirus
NYSIITII

SEQ ID NO: 46220 - protein, 8 aa, Artificial Sequence
  Peptide Derived from Human Papillomavirus
QYVAWKYI

SEQ ID NO: 46221 - protein, 8 aa, Artificial Sequence
  Peptide Derived from Human Papillomavirus
RFQKYKTL

SEQ ID NO: 46222 - protein, 9 aa, Artificial Sequence
  Peptide Derived from Human Papillomavirus
RFQKYKTLF

SEQ ID NO: 46223 - protein, 10 aa, Artificial Sequence
  Peptide Derived from Human Papillomavirus
RYRFQKYKTL

SEQ ID NO: 46224 - protein, 11 aa, Artificial Sequence
  Peptide Derived from Human Papillomavirus
RYRFQKYKTLF

SEQ ID NO: 46225 - protein, 8 aa, Artificial Sequence
  Peptide Derived from Human Papillomavirus
SFLSHVKI

SEQ ID NO: 46226 - protein, 8 aa, Artificial Sequence
  Peptide Derived from Human Papillomavirus
YYNGDCGW

SEQ ID NO: 46227 - protein, 8 aa, Artificial Sequence
  Peptide Derived from Human Papillomavirus
CYRCQSPL

SEQ ID NO: 46228 - protein, 11 aa, Artificial Sequence
  Peptide Derived from Human Papillomavirus
DFPYAVCRVCL

SEQ ID NO: 46229 - protein, 9 aa, Artificial Sequence
  Peptide Derived from Human Papillomavirus
DYSVYGATL

SEQ ID NO: 46230 - protein, 10 aa, Artificial Sequence
  Peptide Derived from Human Papillomavirus
GWTGSCLGCW

SEQ ID NO: 46231 - protein, 9 aa, Artificial Sequence
  Peptide Derived from Human Papillomavirus
NFACTELKL

SEQ ID NO: 46232 - protein, 9 aa, Artificial Sequence
  Peptide Derived from Human Papillomavirus
PYAVCRVCL

SEQ ID NO: 46233 - protein, 10 aa, Artificial Sequence
  Peptide Derived from Human Papillomavirus
PYAVCRVCLL

SEQ ID NO: 46234 - protein, 11 aa, Artificial Sequence
  Peptide Derived from Human Papillomavirus
PYAVCRVCLLF

SEQ ID NO: 46235 - protein, 9 aa, Artificial Sequence
  Peptide Derived from Human Papillomavirus
RFHLIAHGW

SEQ ID NO: 46236 - protein, 9 aa, Artificial Sequence
  Peptide Derived from Human Papillomavirus
VYGATLESI

SEQ ID NO: 46237 - protein, 9 aa, Artificial Sequence
  Peptide Derived from Human Papillomavirus
VYNFACTEL

SEQ ID NO: 46238 - protein, 11 aa, Artificial Sequence
  Peptide Derived from Human Papillomavirus
VYNFACTELKL

SEQ ID NO: 46239 - protein, 11 aa, Artificial Sequence
  Peptide Derived from Human Papillomavirus
YYDYSVYGATL

SEQ ID NO: 46240 - protein, 8 aa, Artificial Sequence
  Peptide Derived from Human Papillomavirus
KFVVQLDI

SEQ ID NO: 46241 - protein, 11 aa, Artificial Sequence
  Peptide Derived from Human Papillomavirus
LMGALTVTCPL

SEQ ID NO: 46242 - protein, 8 aa, Artificial Sequence
  Peptide Derived from Human Papillomavirus
AYGDSMWF

SEQ ID NO: 46243 - protein, 10 aa, Artificial Sequence
  Peptide Derived from Human Papillomavirus
AYGDSMWFYL

SEQ ID NO: 46244 - protein, 10 aa, Artificial Sequence
  Peptide Derived from Human Papillomavirus
AYLHNMNANL

SEQ ID NO: 46245 - protein, 11 aa, Artificial Sequence
  Peptide Derived from Human Papillomavirus
AYLHNMNANLL

SEQ ID NO: 46246 - protein, 11 aa, Artificial Sequence
  Peptide Derived from Human Papillomavirus
AYQYRVFRVRL

SEQ ID NO: 46247 - protein, 8 aa, Artificial Sequence
  Peptide Derived from Human Papillomavirus
EYELQFVF

SEQ ID NO: 46248 - protein, 10 aa, Artificial Sequence
  Peptide Derived from Human Papillomavirus
EYELQFVFQL

SEQ ID NO: 46249 - protein, 10 aa, Artificial Sequence
  Peptide Derived from Human Papillomavirus
FWDVNLQDSF

SEQ ID NO: 46250 - protein, 9 aa, Artificial Sequence
  Peptide Derived from Human Papillomavirus
FYHAGSSRL

SEQ ID NO: 46251 - protein, 10 aa, Artificial Sequence
  Peptide Derived from Human Papillomavirus
FYHAGSSRLL

SEQ ID NO: 46252 - protein, 8 aa, Artificial Sequence
  Peptide Derived from Human Papillomavirus
FYLRREQL

SEQ ID NO: 46253 - protein, 9 aa, Artificial Sequence
  Peptide Derived from Human Papillomavirus
FYLRREQLF

SEQ ID NO: 46254 - protein, 10 aa, Artificial Sequence
  Peptide Derived from Human Papillomavirus
GFGAMDFKVL

SEQ ID NO: 46255 - protein, 8 aa, Artificial Sequence
  Peptide Derived from Human Papillomavirus
HYGLCIFL

SEQ ID NO: 46256 - protein, 11 aa, Artificial Sequence
  Peptide Derived from Human Papillomavirus
IFLDVGAVNVF

SEQ ID NO: 46257 - protein, 8 aa, Artificial Sequence
  Peptide Derived from Human Papillomavirus
IFLQMATW

SEQ ID NO: 46258 - protein, 10 aa, Artificial Sequence
  Peptide Derived from Human Papillomavirus
IFYHAGSSRL

SEQ ID NO: 46259 - protein, 11 aa, Artificial Sequence
  Peptide Derived from Human Papillomavirus
IFYHAGSSRLL

SEQ ID NO: 46260 - protein, 9 aa, Artificial Sequence
  Peptide Derived from Human Papillomavirus
IYNPDQERL

SEQ ID NO: 46261 - protein, 11 aa, Artificial Sequence
  Peptide Derived from Human Papillomavirus
IYNPDQERLVW

SEQ ID NO: 46262 - protein, 11 aa, Artificial Sequence
  Peptide Derived from Human Papillomavirus
IYRDPPLHYGL

SEQ ID NO: 46263 - protein, 9 aa, Artificial Sequence
  Peptide Derived from Human Papillomavirus
KFGLPDTNI

SEQ ID NO: 46264 - protein, 11 aa, Artificial Sequence
  Peptide Derived from Human Papillomavirus
KFWDVNLQDSF

SEQ ID NO: 46265 - protein, 11 aa, Artificial Sequence
  Peptide Derived from Human Papillomavirus
KYDARKINQYL

SEQ ID NO: 46266 - protein, 9 aa, Artificial Sequence
  Peptide Derived from Human Papillomavirus
KYKFWDVNL

SEQ ID NO: 46267 - protein, 10 aa, Artificial Sequence
  Peptide Derived from Human Papillomavirus
KYRYVRSTAI

SEQ ID NO: 46268 - protein, 8 aa, Artificial Sequence
  Peptide Derived from Human Papillomavirus
LFNKPYWL

SEQ ID NO: 46269 - protein, 8 aa, Artificial Sequence
  Peptide Derived from Human Papillomavirus
MMLPMMYI

SEQ ID NO: 46270 - protein, 10 aa, Artificial Sequence
  Peptide Derived from Human Papillomavirus
MMYIYRDPPL

SEQ ID NO: 46271 - protein, 10 aa, Artificial Sequence
  Peptide Derived from Human Papillomavirus
MWFYLRREQL

SEQ ID NO: 46272 - protein, 11 aa, Artificial Sequence
  Peptide Derived from Human Papillomavirus
MWFYLRREQLF

SEQ ID NO: 46273 - protein, 9 aa, Artificial Sequence
  Peptide Derived from Human Papillomavirus
MYIYRDPPL

SEQ ID NO: 46274 - protein, 10 aa, Artificial Sequence
  Peptide Derived from Human Papillomavirus
NMNANLLEDW

SEQ ID NO: 46275 - protein, 11 aa, Artificial Sequence
  Peptide Derived from Human Papillomavirus
NMTISTATEQL

SEQ ID NO: 46276 - protein, 11 aa, Artificial Sequence
  Peptide Derived from Human Papillomavirus
PMMYIYRDPPL

SEQ ID NO: 46277 - protein, 8 aa, Artificial Sequence
  Peptide Derived from Human Papillomavirus
QFPLGRKF

SEQ ID NO: 46278 - protein, 9 aa, Artificial Sequence
  Peptide Derived from Human Papillomavirus
QFPLGRKFL

SEQ ID NO: 46279 - protein, 9 aa, Artificial Sequence
  Peptide Derived from Human Papillomavirus
QFVFQLCKI

SEQ ID NO: 46280 - protein, 11 aa, Artificial Sequence
  Peptide Derived from Human Papillomavirus
QFVFQLCKITL

SEQ ID NO: 46281 - protein, 11 aa, Artificial Sequence
  Peptide Derived from Human Papillomavirus
QYLRHVEEYEL

SEQ ID NO: 46282 - protein, 9 aa, Artificial Sequence
  Peptide Derived from Human Papillomavirus
QYRVFRVRL

SEQ ID NO: 46283 - protein, 8 aa, Artificial Sequence
  Peptide Derived from Human Papillomavirus
RYVRSTAI

SEQ ID NO: 46284 - protein, 9 aa, Artificial Sequence
  Peptide Derived from Human Papillomavirus
SFSTDLDQF

SEQ ID NO: 46285 - protein, 11 aa, Artificial Sequence
  Peptide Derived from Human Papillomavirus
SFSTDLDQFPL

SEQ ID NO: 46286 - protein, 9 aa, Artificial Sequence
  Peptide Derived from Human Papillomavirus
SMITSEAQL

SEQ ID NO: 46287 - protein, 10 aa, Artificial Sequence
  Peptide Derived from Human Papillomavirus
SMITSEAQLF

SEQ ID NO: 46288 - protein, 11 aa, Artificial Sequence
  Peptide Derived from Human Papillomavirus
SMWFYLRREQL

SEQ ID NO: 46289 - protein, 8 aa, Artificial Sequence
  Peptide Derived from Human Papillomavirus
SYVKRTSI

SEQ ID NO: 46290 - protein, 9 aa, Artificial Sequence
  Peptide Derived from Human Papillomavirus
SYVKRTSIF

SEQ ID NO: 46291 - protein, 11 aa, Artificial Sequence
  Peptide Derived from Human Papillomavirus
TWRPSENKVYL

SEQ ID NO: 46292 - protein, 11 aa, Artificial Sequence
  Peptide Derived from Human Papillomavirus
VFPIFLQMATW

SEQ ID NO: 46293 - protein, 9 aa, Artificial Sequence
  Peptide Derived from Human Papillomavirus
VFQLCKITL

SEQ ID NO: 46294 - protein, 11 aa, Artificial Sequence
  Peptide Derived from Human Papillomavirus
VYVATPSGSMI

SEQ ID NO: 46295 - protein, 9 aa, Artificial Sequence
  Peptide Derived from Human Papillomavirus
WFYLRREQL

SEQ ID NO: 46296 - protein, 10 aa, Artificial Sequence
  Peptide Derived from Human Papillomavirus
WFYLRREQLF

SEQ ID NO: 46297 - protein, 9 aa, Artificial Sequence
  Peptide Derived from Human Papillomavirus
AFLDRPATL

SEQ ID NO: 46298 - protein, 11 aa, Artificial Sequence
  Peptide Derived from Human Papillomavirus
AFTTRRGGVRF

SEQ ID NO: 46299 - protein, 8 aa, Artificial Sequence
  Peptide Derived from Human Papillomavirus
DFMNIVAL

SEQ ID NO: 46300 - protein, 10 aa, Artificial Sequence
  Peptide Derived from Human Papillomavirus
FFRRRRRKRI

SEQ ID NO: 46301 - protein, 9 aa, Artificial Sequence
  Peptide Derived from Human Papillomavirus
FYSGPDIVL

SEQ ID NO: 46302 - protein, 10 aa, Artificial Sequence
  Peptide Derived from Human Papillomavirus
GFRRIAAPRL

SEQ ID NO: 46303 - protein, 9 aa, Artificial Sequence
  Peptide Derived from Human Papillomavirus
HYYYDISPI

SEQ ID NO: 46304 - protein, 9 aa, Artificial Sequence
  Peptide Derived from Human Papillomavirus
LFEGTDTSL

SEQ ID NO: 46305 - protein, 11 aa, Artificial Sequence
  Peptide Derived from Human Papillomavirus
LFEGTDTSLAF

SEQ ID NO: 46306 - protein, 8 aa, Artificial Sequence
  Peptide Derived from Human Papillomavirus
LFIDPPVI

SEQ ID NO: 46307 - protein, 8 aa, Artificial Sequence
  Peptide Derived from Human Papillomavirus
LFTYFGGL

SEQ ID NO: 46308 - protein, 10 aa, Artificial Sequence
  Peptide Derived from Human Papillomavirus
LFTYFGGLGI

SEQ ID NO: 46309 - protein, 8 aa, Artificial Sequence
  Peptide Derived from Human Papillomavirus
LYDIYANI

SEQ ID NO: 46310 - protein, 8 aa, Artificial Sequence
  Peptide Derived from Human Papillomavirus
NFTGSGGF

SEQ ID NO: 46311 - protein, 10 aa, Artificial Sequence
  Peptide Derived from Human Papillomavirus
NFTGSGGFEI

SEQ ID NO: 46312 - protein, 8 aa, Artificial Sequence
  Peptide Derived from Human Papillomavirus
PFYSGPDI

SEQ ID NO: 46313 - protein, 10 aa, Artificial Sequence
  Peptide Derived from Human Papillomavirus
PFYSGPDIVL

SEQ ID NO: 46314 - protein, 10 aa, Artificial Sequence
  Peptide Derived from Human Papillomavirus
PYDVTHDVYI

SEQ ID NO: 46315 - protein, 9 aa, Artificial Sequence
  Peptide Derived from Human Papillomavirus
QWGSLFTYF

SEQ ID NO: 46316 - protein, 11 aa, Artificial Sequence
  Peptide Derived from Human Papillomavirus
RFSRLGRKATI

SEQ ID NO: 46317 - protein, 9 aa, Artificial Sequence
  Peptide Derived from Human Papillomavirus
SFALWPVYF

SEQ ID NO: 46318 - protein, 10 aa, Artificial Sequence
  Peptide Derived from Human Papillomavirus
SFALWPVYFF

SEQ ID NO: 46319 - protein, 8 aa, Artificial Sequence
  Peptide Derived from Human Papillomavirus
SFDGLYDI

SEQ ID NO: 46320 - protein, 10 aa, Artificial Sequence
  Peptide Derived from Human Papillomavirus
SYEEIPMQTF

SEQ ID NO: 46321 - protein, 9 aa, Artificial Sequence
  Peptide Derived from Human Papillomavirus
TWADKILQW

SEQ ID NO: 46322 - protein, 8 aa, Artificial Sequence
  Peptide Derived from Human Papillomavirus
TYFGGLGI

SEQ ID NO: 46323 - protein, 8 aa, Artificial Sequence
  Peptide Derived from Human Papillomavirus
VYIQGSSF

SEQ ID NO: 46324 - protein, 10 aa, Artificial Sequence
  Peptide Derived from Human Papillomavirus
VYIQGSSFAL

SEQ ID NO: 46325 - protein, 11 aa, Artificial Sequence
  Peptide Derived from Human Papillomavirus
VYIQGSSFALW

SEQ ID NO: 46326 - protein, 11 aa, Artificial Sequence
  Peptide Derived from Human Papillomavirus
YFFRRRRRKRI

SEQ ID NO: 46327 - protein, 8 aa, Artificial Sequence
  Peptide Derived from Human Papillomavirus
YYYDISPI

SEQ ID NO: 46328 - protein, 15 aa, Artificial Sequence
  Peptide Derived from Human Papillomavirus
AAALYWYKTGISNIS

SEQ ID NO: 46329 - protein, 15 aa, Artificial Sequence
  Peptide Derived from Human Papillomavirus
ACSWGMVVLLLVRYK

SEQ ID NO: 46330 - protein, 15 aa, Artificial Sequence
  Peptide Derived from Human Papillomavirus
AFGLTPSIADSIKTL

SEQ ID NO: 46331 - protein, 15 aa, Artificial Sequence
  Peptide Derived from Human Papillomavirus
AKIVKDCATMCRHYK

SEQ ID NO: 46332 - protein, 15 aa, Artificial Sequence
  Peptide Derived from Human Papillomavirus
ALYWYKTGISNISEV

SEQ ID NO: 46333 - protein, 15 aa, Artificial Sequence
  Peptide Derived from Human Papillomavirus
ASAFLKSNSQAKIVK

SEQ ID NO: 46334 - protein, 15 aa, Artificial Sequence
  Peptide Derived from Human Papillomavirus
CLYLHIQSLACSWGM

SEQ ID NO: 46335 - protein, 15 aa, Artificial Sequence
  Peptide Derived from Human Papillomavirus
CMMIEPPKLRSTAAA

SEQ ID NO: 46336 - protein, 15 aa, Artificial Sequence
  Peptide Derived from Human Papillomavirus
CNGWFYVEAVVEKKT

SEQ ID NO: 46337 - protein, 15 aa, Artificial Sequence
  Peptide Derived from Human Papillomavirus
CWNYIDDNLRNALDG

SEQ ID NO: 46338 - protein, 15 aa, Artificial Sequence
  Peptide Derived from Human Papillomavirus
DCTFELSQMVQWAYD

SEQ ID NO: 46339 - protein, 15 aa, Artificial Sequence
  Peptide Derived from Human Papillomavirus
DGNLVSMDVKHRPLV

SEQ ID NO: 46340 - protein, 15 aa, Artificial Sequence
  Peptide Derived from Human Papillomavirus
DKNWKSFFSRTWSRL

SEQ ID NO: 46341 - protein, 15 aa, Artificial Sequence
  Peptide Derived from Human Papillomavirus
DSEIAYKYAQLADTN

SEQ ID NO: 46342 - protein, 15 aa, Artificial Sequence
  Peptide Derived from Human Papillomavirus
DSGYGNTEVETQQML

SEQ ID NO: 46343 - protein, 15 aa, Artificial Sequence
  Peptide Derived from Human Papillomavirus
DWCIAAFGLTPSIAD

SEQ ID NO: 46344 - protein, 15 aa, Artificial Sequence
  Peptide Derived from Human Papillomavirus
EIAYKYAQLADTNSN

SEQ ID NO: 46345 - protein, 15 aa, Artificial Sequence
  Peptide Derived from Human Papillomavirus
EKLLSKLLCVSPMCM

SEQ ID NO: 46346 - protein, 12 aa, Artificial Sequence
  Peptide Derived from Human Papillomavirus
FKCVSGQNTNTL

SEQ ID NO: 46347 - protein, 15 aa, Artificial Sequence
  Peptide Derived from Human Papillomavirus
GDSLPTFKCVSGQNT

SEQ ID NO: 46348 - protein, 15 aa, Artificial Sequence
  Peptide Derived from Human Papillomavirus
GEDLVDFIVNDNDYL

SEQ ID NO: 46349 - protein, 15 aa, Artificial Sequence
  Peptide Derived from Human Papillomavirus
GEGVSERHTICQTPL

SEQ ID NO: 46350 - protein, 15 aa, Artificial Sequence
  Peptide Derived from Human Papillomavirus
GGDWKQIVMFLRYQG

SEQ ID NO: 46351 - protein, 15 aa, Artificial Sequence
  Peptide Derived from Human Papillomavirus
GKSLFGMSLMKFLQG

SEQ ID NO: 46352 - protein, 15 aa, Artificial Sequence
  Peptide Derived from Human Papillomavirus
GSVICFVNSKSHFWL

SEQ ID NO: 46353 - protein, 15 aa, Artificial Sequence
  Peptide Derived from Human Papillomavirus
GVEFMSFLTALKRFL

SEQ ID NO: 46354 - protein, 15 aa, Artificial Sequence
  Peptide Derived from Human Papillomavirus
GWFYVEAVVEKKTGD

SEQ ID NO: 46355 - protein, 15 aa, Artificial Sequence
  Peptide Derived from Human Papillomavirus
HALFTAQEAKQHRDA

SEQ ID NO: 46356 - protein, 15 aa, Artificial Sequence
  Peptide Derived from Human Papillomavirus
HRPLVQLKCPPLLIT

SEQ ID NO: 46357 - protein, 15 aa, Artificial Sequence
  Peptide Derived from Human Papillomavirus
IAAFGLTPSIADSIK

SEQ ID NO: 46358 - protein, 15 aa, Artificial Sequence
  Peptide Derived from Human Papillomavirus
IEKLLSKLLCVSPMC

SEQ ID NO: 46359 - protein, 15 aa, Artificial Sequence
  Peptide Derived from Human Papillomavirus
IGMLDDATVPCWNYI

SEQ ID NO: 46360 - protein, 15 aa, Artificial Sequence
  Peptide Derived from Human Papillomavirus
IKTLLQQYCLYLHIQ

SEQ ID NO: 46361 - protein, 15 aa, Artificial Sequence
  Peptide Derived from Human Papillomavirus
ILLYGAANTGKSLFG

SEQ ID NO: 46362 - protein, 15 aa, Artificial Sequence
  Peptide Derived from Human Papillomavirus
ISEVYGDTPEWIQRQ

SEQ ID NO: 46363 - protein, 15 aa, Artificial Sequence
  Peptide Derived from Human Papillomavirus
KELYGVSFSELVRPF

SEQ ID NO: 46364 - protein, 15 aa, Artificial Sequence
  Peptide Derived from Human Papillomavirus
KIGMLDDATVPCWNY

SEQ ID NO: 46365 - protein, 15 aa, Artificial Sequence
  Peptide Derived from Human Papillomavirus
KNCILLYGAANTGKS

SEQ ID NO: 46366 - protein, 15 aa, Artificial Sequence
  Peptide Derived from Human Papillomavirus
KRKYLVSPLSDISGC

SEQ ID NO: 46367 - protein, 15 aa, Artificial Sequence
  Peptide Derived from Human Papillomavirus
KSFFSRTWSRLSLHE

SEQ ID NO: 46368 - protein, 15 aa, Artificial Sequence
  Peptide Derived from Human Papillomavirus
KSHFWLQPLADAKIG

SEQ ID NO: 46369 - protein, 15 aa, Artificial Sequence
  Peptide Derived from Human Papillomavirus
KSLFGMSLMKFLQGS

SEQ ID NO: 46370 - protein, 15 aa, Artificial Sequence
  Peptide Derived from Human Papillomavirus
KTLLQQYCLYLHIQS

SEQ ID NO: 46371 - protein, 15 aa, Artificial Sequence
  Peptide Derived from Human Papillomavirus
LKRFLQGIPKKNCIL

SEQ ID NO: 46372 - protein, 15 aa, Artificial Sequence
  Peptide Derived from Human Papillomavirus
LLCVSPMCMMIEPPK

SEQ ID NO: 46373 - protein, 15 aa, Artificial Sequence
  Peptide Derived from Human Papillomavirus
LMKFLQGSVICFVNS

SEQ ID NO: 46374 - protein, 15 aa, Artificial Sequence
  Peptide Derived from Human Papillomavirus
LNVLKTSNAKAAMLA

SEQ ID NO: 46375 - protein, 15 aa, Artificial Sequence
  Peptide Derived from Human Papillomavirus
LQGIPKKNCILLYGA

SEQ ID NO: 46376 - protein, 15 aa, Artificial Sequence
  Peptide Derived from Human Papillomavirus
LQPLADAKIGMLDDA

SEQ ID NO: 46377 - protein, 15 aa, Artificial Sequence
  Peptide Derived from Human Papillomavirus
LSKLLCVSPMCMMIE

SEQ ID NO: 46378 - protein, 15 aa, Artificial Sequence
  Peptide Derived from Human Papillomavirus
LVQLKCPPLLITSNI

SEQ ID NO: 46379 - protein, 15 aa, Artificial Sequence
  Peptide Derived from Human Papillomavirus
LYGVSFSELVRPFKS

SEQ ID NO: 46380 - protein, 15 aa, Artificial Sequence
  Peptide Derived from Human Papillomavirus
LYWYKTGISNISEVY

SEQ ID NO: 46381 - protein, 15 aa, Artificial Sequence
  Peptide Derived from Human Papillomavirus
MKFLQGSVICFVNSK

SEQ ID NO: 46382 - protein, 15 aa, Artificial Sequence
  Peptide Derived from Human Papillomavirus
MSQWIKYRCDRVDDG

SEQ ID NO: 46383 - protein, 15 aa, Artificial Sequence
  Peptide Derived from Human Papillomavirus
NCILLYGAANTGKSL

SEQ ID NO: 46384 - protein, 15 aa, Artificial Sequence
  Peptide Derived from Human Papillomavirus
NDIVDDSEIAYKYAQ

SEQ ID NO: 46385 - protein, 15 aa, Artificial Sequence
  Peptide Derived from Human Papillomavirus
NDYLTQAETETAHAL

SEQ ID NO: 46386 - protein, 15 aa, Artificial Sequence
  Peptide Derived from Human Papillomavirus
NGWFYVEAVVEKKTG

SEQ ID NO: 46387 - protein, 15 aa, Artificial Sequence
  Peptide Derived from Human Papillomavirus
NRLVVFTFPNEFPFD

SEQ ID NO: 46388 - protein, 15 aa, Artificial Sequence
  Peptide Derived from Human Papillomavirus
NTEVETQQMLQVEGR

SEQ ID NO: 46389 - protein, 15 aa, Artificial Sequence
  Peptide Derived from Human Papillomavirus
PEWIQRQTVLQHSFN

SEQ ID NO: 46390 - protein, 15 aa, Artificial Sequence
  Peptide Derived from Human Papillomavirus
PMCMMIEPPKLRSTA

SEQ ID NO: 46391 - protein, 15 aa, Artificial Sequence
  Peptide Derived from Human Papillomavirus
PPKLRSTAAALYWYK

SEQ ID NO: 46392 - protein, 15 aa, Artificial Sequence
  Peptide Derived from Human Papillomavirus
PPLLITSNINAGTDS

SEQ ID NO: 46393 - protein, 15 aa, Artificial Sequence
  Peptide Derived from Human Papillomavirus
QAKIVKDCATMCRHY

SEQ ID NO: 46394 - protein, 15 aa, Artificial Sequence
  Peptide Derived from Human Papillomavirus
QWAYDNDIVDDSEIA

SEQ ID NO: 46395 - protein, 15 aa, Artificial Sequence
  Peptide Derived from Human Papillomavirus
RETIEKLLSKLLCVS

SEQ ID NO: 46396 - protein, 15 aa, Artificial Sequence
  Peptide Derived from Human Papillomavirus
RHTICQTPLTNILNV

SEQ ID NO: 46397 - protein, 15 aa, Artificial Sequence
  Peptide Derived from Human Papillomavirus
RKYLVSPLSDISGCV

SEQ ID NO: 46398 - protein, 15 aa, Artificial Sequence
  Peptide Derived from Human Papillomavirus
RNALDGNLVSMDVKH

SEQ ID NO: 46399 - protein, 15 aa, Artificial Sequence
  Peptide Derived from Human Papillomavirus
RPLVQLKCPPLLITS

SEQ ID NO: 46400 - protein, 15 aa, Artificial Sequence
  Peptide Derived from Human Papillomavirus
RRLFESEDSGYGNTE

SEQ ID NO: 46401 - protein, 15 aa, Artificial Sequence
  Peptide Derived from Human Papillomavirus
RWPYLHNRLVVFTFP

SEQ ID NO: 46402 - protein, 15 aa, Artificial Sequence
  Peptide Derived from Human Papillomavirus
SELVRPFKSNKSTCC

SEQ ID NO: 46403 - protein, 15 aa, Artificial Sequence
  Peptide Derived from Human Papillomavirus
SGCVDNNISPRLKAI

SEQ ID NO: 46404 - protein, 15 aa, Artificial Sequence
  Peptide Derived from Human Papillomavirus
SHFWLQPLADAKIGM

SEQ ID NO: 46405 - protein, 15 aa, Artificial Sequence
  Peptide Derived from Human Papillomavirus
SKLLCVSPMCMMIEP

SEQ ID NO: 46406 - protein, 15 aa, Artificial Sequence
  Peptide Derived from Human Papillomavirus
SMDVKHRPLVQLKCP

SEQ ID NO: 46407 - protein, 15 aa, Artificial Sequence
  Peptide Derived from Human Papillomavirus
SPRLKAICIEKQSRA

SEQ ID NO: 46408 - protein, 15 aa, Artificial Sequence
  Peptide Derived from Human Papillomavirus
SRTWSRLSLHEDEDK

SEQ ID NO: 46409 - protein, 15 aa, Artificial Sequence
  Peptide Derived from Human Papillomavirus
SWGMVVLLLVRYKCG

SEQ ID NO: 46410 - protein, 15 aa, Artificial Sequence
  Peptide Derived from Human Papillomavirus
TNILNVLKTSNAKAA

SEQ ID NO: 46411 - protein, 15 aa, Artificial Sequence
  Peptide Derived from Human Papillomavirus
TPEWIQRQTVLQHSF

SEQ ID NO: 46412 - protein, 15 aa, Artificial Sequence
  Peptide Derived from Human Papillomavirus
VEAVVEKKTGDAISD

SEQ ID NO: 46413 - protein, 15 aa, Artificial Sequence
  Peptide Derived from Human Papillomavirus
VEFMSFLTALKRFLQ

SEQ ID NO: 46414 - protein, 15 aa, Artificial Sequence
  Peptide Derived from Human Papillomavirus
VFTFPNEFPFDENGN

SEQ ID NO: 46415 - protein, 15 aa, Artificial Sequence
  Peptide Derived from Human Papillomavirus
VICFVNSKSHFWLQP

SEQ ID NO: 46416 - protein, 15 aa, Artificial Sequence
  Peptide Derived from Human Papillomavirus
VLLLVRYKCGKNRET

SEQ ID NO: 46417 - protein, 15 aa, Artificial Sequence
  Peptide Derived from Human Papillomavirus
VMFLRYQGVEFMSFL

SEQ ID NO: 46418 - protein, 15 aa, Artificial Sequence
  Peptide Derived from Human Papillomavirus
VQVLKRKYLVSPLSD

SEQ ID NO: 46419 - protein, 15 aa, Artificial Sequence
  Peptide Derived from Human Papillomavirus
VRPFKSNKSTCCDWC

SEQ ID NO: 46420 - protein, 15 aa, Artificial Sequence
  Peptide Derived from Human Papillomavirus
WGMVVLLLVRYKCGK

SEQ ID NO: 46421 - protein, 15 aa, Artificial Sequence
  Peptide Derived from Human Papillomavirus
WIKYRCDRVDDGGDW

SEQ ID NO: 46422 - protein, 15 aa, Artificial Sequence
  Peptide Derived from Human Papillomavirus
WPYLHNRLVVFTFPN

SEQ ID NO: 46423 - protein, 15 aa, Artificial Sequence
  Peptide Derived from Human Papillomavirus
YAQLADTNSNASAFL

SEQ ID NO: 46424 - protein, 15 aa, Artificial Sequence
  Peptide Derived from Human Papillomavirus
YCLYLHIQSLACSWG

SEQ ID NO: 46425 - protein, 15 aa, Artificial Sequence
  Peptide Derived from Human Papillomavirus
YLHIQSLACSWGMVV

SEQ ID NO: 46426 - protein, 15 aa, Artificial Sequence
  Peptide Derived from Human Papillomavirus
AEKYSKNKVWEVHAG

SEQ ID NO: 46427 - protein, 15 aa, Artificial Sequence
  Peptide Derived from Human Papillomavirus
AIYYKAREMGFKHIN

SEQ ID NO: 46428 - protein, 15 aa, Artificial Sequence
  Peptide Derived from Human Papillomavirus
APILTAFNSSHKGRI

SEQ ID NO: 46429 - protein, 15 aa, Artificial Sequence
  Peptide Derived from Human Papillomavirus
AREMGFKHINHQVVP

SEQ ID NO: 46430 - protein, 15 aa, Artificial Sequence
  Peptide Derived from Human Papillomavirus
AVALGTEETQTTIQR

SEQ ID NO: 46431 - protein, 15 aa, Artificial Sequence
  Peptide Derived from Human Papillomavirus
CTLYTAVSSTWHWTG

SEQ ID NO: 46432 - protein, 15 aa, Artificial Sequence
  Peptide Derived from Human Papillomavirus
DQFLSQVKIPKTITV

SEQ ID NO: 46433 - protein, 15 aa, Artificial Sequence
  Peptide Derived from Human Papillomavirus
DVSLEVYLTAPTGCI

SEQ ID NO: 46434 - protein, 15 aa, Artificial Sequence
  Peptide Derived from Human Papillomavirus
EGQVDYYGLYYVHEG

SEQ ID NO: 46435 - protein, 15 aa, Artificial Sequence
  Peptide Derived from Human Papillomavirus
ELQLTLETIYNSQYS

SEQ ID NO: 46436 - protein, 15 aa, Artificial Sequence
  Peptide Derived from Human Papillomavirus
ETIYNSQYSNEKWTL

SEQ ID NO: 46437 - protein, 15 aa, Artificial Sequence
  Peptide Derived from Human Papillomavirus
EVQFDGDICNTMHYT

SEQ ID NO: 46438 - protein, 15 aa, Artificial Sequence
  Peptide Derived from Human Papillomavirus
FKHINHQVVPTLAVS

SEQ ID NO: 46439 - protein, 15 aa, Artificial Sequence
  Peptide Derived from Human Papillomavirus
GGQVILCPTSVFSSN

SEQ ID NO: 46440 - protein, 15 aa, Artificial Sequence
  Peptide Derived from Human Papillomavirus
GHNVKHKSAIVTLTY

SEQ ID NO: 46441 - protein, 15 aa, Artificial Sequence
  Peptide Derived from Human Papillomavirus
GLYYVHEGIRTYFVQ

SEQ ID NO: 46442 - protein, 15 aa, Artificial Sequence
  Peptide Derived from Human Papillomavirus
GQVILCPTSVFSSNE

SEQ ID NO: 46443 - protein, 15 aa, Artificial Sequence
  Peptide Derived from Human Papillomavirus
HCTLYTAVSSTWHWT

SEQ ID NO: 46444 - protein, 15 aa, Artificial Sequence
  Peptide Derived from Human Papillomavirus
HEGIRTYFVQFKDDA

SEQ ID NO: 46445 - protein, 15 aa, Artificial Sequence
  Peptide Derived from Human Papillomavirus
HIYICEEASVTVVEG

SEQ ID NO: 46446 - protein, 15 aa, Artificial Sequence
  Peptide Derived from Human Papillomavirus
HQVVPTLAVSKNKAL

SEQ ID NO: 46447 - protein, 15 aa, Artificial Sequence
  Peptide Derived from Human Papillomavirus
IDYWKHMRLECAIYY

SEQ ID NO: 46448 - protein, 15 aa, Artificial Sequence
  Peptide Derived from Human Papillomavirus
KNKVWEVHAGGQVIL

SEQ ID NO: 46449 - protein, 15 aa, Artificial Sequence
  Peptide Derived from Human Papillomavirus
KWTLQDVSLEVYLTA

SEQ ID NO: 46450 - protein, 15 aa, Artificial Sequence
  Peptide Derived from Human Papillomavirus
LEVYLTAPTGCIKKH

SEQ ID NO: 46451 - protein, 15 aa, Artificial Sequence
  Peptide Derived from Human Papillomavirus
LQAIELQLTLETIYN

SEQ ID NO: 46452 - protein, 15 aa, Artificial Sequence
  Peptide Derived from Human Papillomavirus
LSQVKIPKTITVSTG

SEQ ID NO: 46453 - protein, 15 aa, Artificial Sequence
  Peptide Derived from Human Papillomavirus
LTHYENDSTDLRDHI

SEQ ID NO: 46454 - protein, 15 aa, Artificial Sequence
  Peptide Derived from Human Papillomavirus
NEKWTLQDVSLEVYL

SEQ ID NO: 46455 - protein, 15 aa, Artificial Sequence
  Peptide Derived from Human Papillomavirus
NHQVVPTLAVSKNKA

SEQ ID NO: 46456 - protein, 15 aa, Artificial Sequence
  Peptide Derived from Human Papillomavirus
NKALQAIELQLTLET

SEQ ID NO: 46457 - protein, 15 aa, Artificial Sequence
  Peptide Derived from Human Papillomavirus
PEIIRQHLANHPAAT

SEQ ID NO: 46458 - protein, 15 aa, Artificial Sequence
  Peptide Derived from Human Papillomavirus
QTTIQRPRSEPDTGN

SEQ ID NO: 46459 - protein, 15 aa, Artificial Sequence
  Peptide Derived from Human Papillomavirus
QVILCPTSVFSSNEV

SEQ ID NO: 46460 - protein, 15 aa, Artificial Sequence
  Peptide Derived from Human Papillomavirus
QVKIPKTITVSTGFM

SEQ ID NO: 46461 - protein, 15 aa, Artificial Sequence
  Peptide Derived from Human Papillomavirus
RDSVDSAPILTAFNS

SEQ ID NO: 46462 - protein, 15 aa, Artificial Sequence
  Peptide Derived from Human Papillomavirus
RLNVCQDKILTHYEN

SEQ ID NO: 46463 - protein, 15 aa, Artificial Sequence
  Peptide Derived from Human Papillomavirus
RQHLANHPAATHTKA

SEQ ID NO: 46464 - protein, 15 aa, Artificial Sequence
  Peptide Derived from Human Papillomavirus
RYRFKKHCTLYTAVS

SEQ ID NO: 46465 - protein, 15 aa, Artificial Sequence
  Peptide Derived from Human Papillomavirus
SLEVYLTAPTGCIKK

SEQ ID NO: 46466 - protein, 15 aa, Artificial Sequence
  Peptide Derived from Human Papillomavirus
SNEVSSPEIIRQHLA

SEQ ID NO: 46467 - protein, 15 aa, Artificial Sequence
  Peptide Derived from Human Papillomavirus
SPEIIRQHLANHPAA

SEQ ID NO: 46468 - protein, 15 aa, Artificial Sequence
  Peptide Derived from Human Papillomavirus
SVTVVEGQVDYYGLY

SEQ ID NO: 46469 - protein, 15 aa, Artificial Sequence
  Peptide Derived from Human Papillomavirus
THIYICEEASVTVVE

SEQ ID NO: 46470 - protein, 15 aa, Artificial Sequence
  Peptide Derived from Human Papillomavirus
TKLLHRDSVDSAPIL

SEQ ID NO: 46471 - protein, 15 aa, Artificial Sequence
  Peptide Derived from Human Papillomavirus
TLAVSKNKALQAIEL

SEQ ID NO: 46472 - protein, 15 aa, Artificial Sequence
  Peptide Derived from Human Papillomavirus
TSVFSSNEVSSPEII

SEQ ID NO: 46473 - protein, 15 aa, Artificial Sequence
  Peptide Derived from Human Papillomavirus
TTKLLHRDSVDSAPI

SEQ ID NO: 46474 - protein, 15 aa, Artificial Sequence
  Peptide Derived from Human Papillomavirus
TWHWTGHNVKHKSAI

SEQ ID NO: 46475 - protein, 15 aa, Artificial Sequence
  Peptide Derived from Human Papillomavirus
VDYYGLYYVHEGIRT

SEQ ID NO: 46476 - protein, 15 aa, Artificial Sequence
  Peptide Derived from Human Papillomavirus
WKHMRLECAIYYKAR

SEQ ID NO: 46477 - protein, 15 aa, Artificial Sequence
  Peptide Derived from Human Papillomavirus
YTNWTHIYICEEASV

SEQ ID NO: 46478 - protein, 15 aa, Artificial Sequence
  Peptide Derived from Human Papillomavirus
  VARIANT 1, 2, 3: Xaa= Any amino acid
XXXMTNLDTASTTLL

SEQ ID NO: 46479 - protein, 15 aa, Artificial Sequence
  Peptide Derived from Human Papillomavirus
ACFLLCFCVLLCVCL

SEQ ID NO: 46480 - protein, 15 aa, Artificial Sequence
  Peptide Derived from Human Papillomavirus
ASAFRCFIVYIIFVY

SEQ ID NO: 46481 - protein, 15 aa, Artificial Sequence
  Peptide Derived from Human Papillomavirus
CFCVLLCVCLLIRPL

SEQ ID NO: 46482 - protein, 15 aa, Artificial Sequence
  Peptide Derived from Human Papillomavirus
CFIVYIIFVYIPLFL

SEQ ID NO: 46483 - protein, 15 aa, Artificial Sequence
  Peptide Derived from Human Papillomavirus
CFLLCFCVLLCVCLL

SEQ ID NO: 46484 - protein, 15 aa, Artificial Sequence
  Peptide Derived from Human Papillomavirus
CLLIRPLLLSVSTYT

SEQ ID NO: 46485 - protein, 15 aa, Artificial Sequence
  Peptide Derived from Human Papillomavirus
CVCLLIRPLLLSVST

SEQ ID NO: 46486 - protein, 15 aa, Artificial Sequence
  Peptide Derived from Human Papillomavirus
CVLLCVCLLIRPLLL

SEQ ID NO: 46487 - protein, 15 aa, Artificial Sequence
  Peptide Derived from Human Papillomavirus
FCVLLCVCLLIRPLL

SEQ ID NO: 46488 - protein, 15 aa, Artificial Sequence
  Peptide Derived from Human Papillomavirus
FRCFIVYIIFVYIPL

SEQ ID NO: 46489 - protein, 15 aa, Artificial Sequence
  Peptide Derived from Human Papillomavirus
FVYIPLFLIHTHARF

SEQ ID NO: 46490 - protein, 15 aa, Artificial Sequence
  Peptide Derived from Human Papillomavirus
IFVYIPLFLIHTHAR

SEQ ID NO: 46491 - protein, 15 aa, Artificial Sequence
  Peptide Derived from Human Papillomavirus
IILVLLLWITAASAF

SEQ ID NO: 46492 - protein, 15 aa, Artificial Sequence
  Peptide Derived from Human Papillomavirus
ILVLLLWITAASAFR

SEQ ID NO: 46493 - protein, 15 aa, Artificial Sequence
  Peptide Derived from Human Papillomavirus
IRPLLLSVSTYTSLI

SEQ ID NO: 46494 - protein, 15 aa, Artificial Sequence
  Peptide Derived from Human Papillomavirus
IVYIIFVYIPLFLIH

SEQ ID NO: 46495 - protein, 15 aa, Artificial Sequence
  Peptide Derived from Human Papillomavirus
LACFLLCFCVLLCVC

SEQ ID NO: 46496 - protein, 15 aa, Artificial Sequence
  Peptide Derived from Human Papillomavirus
LLCFCVLLCVCLLIR

SEQ ID NO: 46497 - protein, 15 aa, Artificial Sequence
  Peptide Derived from Human Papillomavirus
LLLWITAASAFRCFI

SEQ ID NO: 46498 - protein, 15 aa, Artificial Sequence
  Peptide Derived from Human Papillomavirus
LLSVSTYTSLIILVL

SEQ ID NO: 46499 - protein, 15 aa, Artificial Sequence
  Peptide Derived from Human Papillomavirus
LLWITAASAFRCFIV

SEQ ID NO: 46500 - protein, 15 aa, Artificial Sequence
  Peptide Derived from Human Papillomavirus
LVLLLWITAASAFRC

SEQ ID NO: 46501 - protein, 15 aa, Artificial Sequence
  Peptide Derived from Human Papillomavirus
MTNLDTASTTLLACF

SEQ ID NO: 46502 - protein, 14 aa, Artificial Sequence
  Peptide Derived from Human Papillomavirus
PLFLIHTHARFLIT

SEQ ID NO: 46503 - protein, 15 aa, Artificial Sequence
  Peptide Derived from Human Papillomavirus
RPLLLSVSTYTSLII

SEQ ID NO: 46504 - protein, 15 aa, Artificial Sequence
  Peptide Derived from Human Papillomavirus
SLIILVLLLWITAAS

SEQ ID NO: 46505 - protein, 15 aa, Artificial Sequence
  Peptide Derived from Human Papillomavirus
STTLLACFLLCFCVL

SEQ ID NO: 46506 - protein, 15 aa, Artificial Sequence
  Peptide Derived from Human Papillomavirus
TSLIILVLLLWITAA

SEQ ID NO: 46507 - protein, 15 aa, Artificial Sequence
  Peptide Derived from Human Papillomavirus
TTLLACFLLCFCVLL

SEQ ID NO: 46508 - protein, 15 aa, Artificial Sequence
  Peptide Derived from Human Papillomavirus
VCLLIRPLLLSVSTY

SEQ ID NO: 46509 - protein, 15 aa, Artificial Sequence
  Peptide Derived from Human Papillomavirus
VLLLWITAASAFRCF

SEQ ID NO: 46510 - protein, 15 aa, Artificial Sequence
  Peptide Derived from Human Papillomavirus
VSTYTSLIILVLLLW

SEQ ID NO: 46511 - protein, 15 aa, Artificial Sequence
  Peptide Derived from Human Papillomavirus
VYIIFVYIPLFLIHT

SEQ ID NO: 46512 - protein, 15 aa, Artificial Sequence
  Peptide Derived from Human Papillomavirus
YIIFVYIPLFLIHTH

SEQ ID NO: 46513 - protein, 15 aa, Artificial Sequence
  Peptide Derived from Human Papillomavirus
YIPLFLIHTHARFLI

SEQ ID NO: 46514 - protein, 15 aa, Artificial Sequence
  Peptide Derived from Human Papillomavirus
YTSLIILVLLLWITA

SEQ ID NO: 46515 - protein, 15 aa, Artificial Sequence
  Peptide Derived from Human Papillomavirus
  VARIANT 1, 2, 3: Xaa= Any amino acid
XXXMHQKRTAMFQDP

SEQ ID NO: 46516 - protein, 15 aa, Artificial Sequence
  Peptide Derived from Human Papillomavirus
CIVYRDGNPYAVCDK

SEQ ID NO: 46517 - protein, 15 aa, Artificial Sequence
  Peptide Derived from Human Papillomavirus
CLKFYSKISEYRHYC

SEQ ID NO: 46518 - protein, 15 aa, Artificial Sequence
  Peptide Derived from Human Papillomavirus
CYSLYGTTLEQQYNK

SEQ ID NO: 46519 - protein, 15 aa, Artificial Sequence
  Peptide Derived from Human Papillomavirus
DFAFRDLCIVYRDGN

SEQ ID NO: 46520 - protein, 15 aa, Artificial Sequence
  Peptide Derived from Human Papillomavirus
DIILECVYCKQQLLR

SEQ ID NO: 46521 - protein, 15 aa, Artificial Sequence
  Peptide Derived from Human Papillomavirus
DLLIRCINCQKPLCP

SEQ ID NO: 46522 - protein, 15 aa, Artificial Sequence
  Peptide Derived from Human Papillomavirus
ECVYCKQQLLRREVY

SEQ ID NO: 46523 - protein, 15 aa, Artificial Sequence
  Peptide Derived from Human Papillomavirus
EQQYNKPLCDLLIRC

SEQ ID NO: 46524 - protein, 15 aa, Artificial Sequence
  Peptide Derived from Human Papillomavirus
FHNIRGRWTGRCMSC

SEQ ID NO: 46525 - protein, 15 aa, Artificial Sequence
  Peptide Derived from Human Papillomavirus
GRCMSCCRSSRTRRE

SEQ ID NO: 46526 - protein, 15 aa, Artificial Sequence
  Peptide Derived from Human Papillomavirus
HYCYSLYGTTLEQQY

SEQ ID NO: 46527 - protein, 15 aa, Artificial Sequence
  Peptide Derived from Human Papillomavirus
IHDIILECVYCKQQL

SEQ ID NO: 46528 - protein, 15 aa, Artificial Sequence
  Peptide Derived from Human Papillomavirus
IRCINCQKPLCPEEK

SEQ ID NO: 46529 - protein, 15 aa, Artificial Sequence
  Peptide Derived from Human Papillomavirus
KQQLLRREVYDFAFR

SEQ ID NO: 46530 - protein, 15 aa, Artificial Sequence
  Peptide Derived from Human Papillomavirus
LCDLLIRCINCQKPL

SEQ ID NO: 46531 - protein, 15 aa, Artificial Sequence
  Peptide Derived from Human Papillomavirus
NKPLCDLLIRCINCQ

SEQ ID NO: 46532 - protein, 15 aa, Artificial Sequence
  Peptide Derived from Human Papillomavirus
PRKLPQLCTELQTTI

SEQ ID NO: 46533 - protein, 15 aa, Artificial Sequence
  Peptide Derived from Human Papillomavirus
PYAVCDKCLKFYSKI

SEQ ID NO: 46534 - protein, 15 aa, Artificial Sequence
  Peptide Derived from Human Papillomavirus
QTTIHDIILECVYCK

SEQ ID NO: 46535 - protein, 15 aa, Artificial Sequence
  Peptide Derived from Human Papillomavirus
RGRWTGRCMSCCRSS

SEQ ID NO: 46536 - protein, 15 aa, Artificial Sequence
  Peptide Derived from Human Papillomavirus
VYDFAFRDLCIVYRD

SEQ ID NO: 46537 - protein, 15 aa, Artificial Sequence
  Peptide Derived from Human Papillomavirus
  VARIANT 1, 2, 3: Xaa= Any amino acid
XXXMHGDTPTLHEYM

SEQ ID NO: 46538 - protein, 15 aa, Artificial Sequence
  Peptide Derived from Human Papillomavirus
DLLMGTLGIVCPICS

SEQ ID NO: 46539 - protein, 15 aa, Artificial Sequence
  Peptide Derived from Human Papillomavirus
HEYMLDLQPETTDLY

SEQ ID NO: 46540 - protein, 15 aa, Artificial Sequence
  Peptide Derived from Human Papillomavirus
HYNIVTFCCKCDSTL

SEQ ID NO: 46541 - protein, 15 aa, Artificial Sequence
  Peptide Derived from Human Papillomavirus
IRTLEDLLMGTLGIV

SEQ ID NO: 46542 - protein, 15 aa, Artificial Sequence
  Peptide Derived from Human Papillomavirus
LEDLLMGTLGIVCPI

SEQ ID NO: 46543 - protein, 12 aa, Artificial Sequence
  Peptide Derived from Human Papillomavirus
LGIVCPICSQKP

SEQ ID NO: 46544 - protein, 15 aa, Artificial Sequence
  Peptide Derived from Human Papillomavirus
MGTLGIVCPICSQKP

SEQ ID NO: 46545 - protein, 15 aa, Artificial Sequence
  Peptide Derived from Human Papillomavirus
MLDLQPETTDLYCYE

SEQ ID NO: 46546 - protein, 15 aa, Artificial Sequence
  Peptide Derived from Human Papillomavirus
RLCVQSTHVDIRTLE

SEQ ID NO: 46547 - protein, 15 aa, Artificial Sequence
  Peptide Derived from Human Papillomavirus
STHVDIRTLEDLLMG

SEQ ID NO: 46548 - protein, 15 aa, Artificial Sequence
  Peptide Derived from Human Papillomavirus
TDLYCYEQLNDSSEE

SEQ ID NO: 46549 - protein, 13 aa, Artificial Sequence
  Peptide Derived from Human Papillomavirus
TLGIVCPICSQKP

SEQ ID NO: 46550 - protein, 15 aa, Artificial Sequence
  Peptide Derived from Human Papillomavirus
TLRLCVQSTHVDIRT

SEQ ID NO: 46551 - protein, 15 aa, Artificial Sequence
  Peptide Derived from Human Papillomavirus
TPTLHEYMLDLQPET

SEQ ID NO: 46552 - protein, 15 aa, Artificial Sequence
  Peptide Derived from Human Papillomavirus
  VARIANT 1, 2, 3: Xaa= Any amino acid
XXXMQVTFIYILVIT

SEQ ID NO: 46553 - protein, 15 aa, Artificial Sequence
  Peptide Derived from Human Papillomavirus
  VARIANT 1: Xaa= Any amino acid
XMQVTFIYILVITCY

SEQ ID NO: 46554 - protein, 15 aa, Artificial Sequence
  Peptide Derived from Human Papillomavirus
ADVMTYIHSMNSTIL

SEQ ID NO: 46555 - protein, 15 aa, Artificial Sequence
  Peptide Derived from Human Papillomavirus
AGAVGENVPDDLYIK

SEQ ID NO: 46556 - protein, 15 aa, Artificial Sequence
  Peptide Derived from Human Papillomavirus
AMDFTTLQANKSEVP

SEQ ID NO: 46557 - protein, 15 aa, Artificial Sequence
  Peptide Derived from Human Papillomavirus
ATVYLPPVPVSKVVS

SEQ ID NO: 46558 - protein, 15 aa, Artificial Sequence
  Peptide Derived from Human Papillomavirus
CAAISTSETTYKNTN

SEQ ID NO: 46559 - protein, 15 aa, Artificial Sequence
  Peptide Derived from Human Papillomavirus
CISMDYKQTQLCLIG

SEQ ID NO: 46560 - protein, 15 aa, Artificial Sequence
  Peptide Derived from Human Papillomavirus
CPPLELINTVIQDGD

SEQ ID NO: 46561 - protein, 15 aa, Artificial Sequence
  Peptide Derived from Human Papillomavirus
DEYVARTNIYYHAGT

SEQ ID NO: 46562 - protein, 15 aa, Artificial Sequence
  Peptide Derived from Human Papillomavirus
DLQFIFQLCKITLTA

SEQ ID NO: 46563 - protein, 15 aa, Artificial Sequence
  Peptide Derived from Human Papillomavirus
DLYIKGSGSTANLAS

SEQ ID NO: 46564 - protein, 15 aa, Artificial Sequence
  Peptide Derived from Human Papillomavirus
DTSFYNPDTQRLVWA

SEQ ID NO: 46565 - protein, 15 aa, Artificial Sequence
  Peptide Derived from Human Papillomavirus
DWNFGLQPPPGGTLE

SEQ ID NO: 46566 - protein, 15 aa, Artificial Sequence
  Peptide Derived from Human Papillomavirus
EATVYLPPVPVSKVV

SEQ ID NO: 46567 - protein, 15 aa, Artificial Sequence
  Peptide Derived from Human Papillomavirus
EDTYRFVTSQAIACQ

SEQ ID NO: 46568 - protein, 15 aa, Artificial Sequence
  Peptide Derived from Human Papillomavirus
ENDVNVYHIFFQMSL

SEQ ID NO: 46569 - protein, 15 aa, Artificial Sequence
  Peptide Derived from Human Papillomavirus
EVNLKEKFSADLDQF

SEQ ID NO: 46570 - protein, 15 aa, Artificial Sequence
  Peptide Derived from Human Papillomavirus
EVPLDICTSICKYPD

SEQ ID NO: 46571 - protein, 15 aa, Artificial Sequence
  Peptide Derived from Human Papillomavirus
FFQMSLWLPSEATVY

SEQ ID NO: 46572 - protein, 15 aa, Artificial Sequence
  Peptide Derived from Human Papillomavirus
FFYLRREQMFVRHLF

SEQ ID NO: 46573 - protein, 15 aa, Artificial Sequence
  Peptide Derived from Human Papillomavirus
FGAMDFTTLQANKSE

SEQ ID NO: 46574 - protein, 15 aa, Artificial Sequence
  Peptide Derived from Human Papillomavirus
FIYILVITCYENDVN

SEQ ID NO: 46575 - protein, 15 aa, Artificial Sequence
  Peptide Derived from Human Papillomavirus
FTTLQANKSEVPLDI

SEQ ID NO: 46576 - protein, 15 aa, Artificial Sequence
  Peptide Derived from Human Papillomavirus
GEEYDLQFIFQLCKI

SEQ ID NO: 46577 - protein, 15 aa, Artificial Sequence
  Peptide Derived from Human Papillomavirus
GEHWGKGSPCTNVAV

SEQ ID NO: 46578 - protein, 15 aa, Artificial Sequence
  Peptide Derived from Human Papillomavirus
GLQYRVFRIHLPDPN

SEQ ID NO: 46579 - protein, 15 aa, Artificial Sequence
  Peptide Derived from Human Papillomavirus
GNQLFVTVVDTTRST

SEQ ID NO: 46580 - protein, 15 aa, Artificial Sequence
  Peptide Derived from Human Papillomavirus
GQPLGVGISGHPLLN

SEQ ID NO: 46581 - protein, 15 aa, Artificial Sequence
  Peptide Derived from Human Papillomavirus
GVEVGRGQPLGVGIS

SEQ ID NO: 46582 - protein, 15 aa, Artificial Sequence
  Peptide Derived from Human Papillomavirus
GVGISGHPLLNKLDD

SEQ ID NO: 46583 - protein, 15 aa, Artificial Sequence
  Peptide Derived from Human Papillomavirus
HPYFPIKKPNNNKIL

SEQ ID NO: 46584 - protein, 15 aa, Artificial Sequence
  Peptide Derived from Human Papillomavirus
IFQLCKITLTADVMT

SEQ ID NO: 46585 - protein, 15 aa, Artificial Sequence
  Peptide Derived from Human Papillomavirus
IHSMNSTILEDWNFG

SEQ ID NO: 46586 - protein, 15 aa, Artificial Sequence
  Peptide Derived from Human Papillomavirus
KFTLGKRKATPTTSS

SEQ ID NO: 46587 - protein, 15 aa, Artificial Sequence
  Peptide Derived from Human Papillomavirus
KITLTADVMTYIHSM

SEQ ID NO: 46588 - protein, 15 aa, Artificial Sequence
  Peptide Derived from Human Papillomavirus
KSEVPLDICTSICKY

SEQ ID NO: 46589 - protein, 15 aa, Artificial Sequence
  Peptide Derived from Human Papillomavirus
KYTFWEVNLKEKFSA

SEQ ID NO: 46590 - protein, 15 aa, Artificial Sequence
  Peptide Derived from Human Papillomavirus
LCLIGCKPPIGEHWG

SEQ ID NO: 46591 - protein, 15 aa, Artificial Sequence
  Peptide Derived from Human Papillomavirus
LKKYTFWEVNLKEKF

SEQ ID NO: 46592 - protein, 15 aa, Artificial Sequence
  Peptide Derived from Human Papillomavirus
LPPVPVSKVVSTDEY

SEQ ID NO: 46593 - protein, 15 aa, Artificial Sequence
  Peptide Derived from Human Papillomavirus
MSLWLPSEATVYLPP

SEQ ID NO: 46594 - protein, 15 aa, Artificial Sequence
  Peptide Derived from Human Papillomavirus
MTYIHSMNSTILEDW

SEQ ID NO: 46595 - protein, 15 aa, Artificial Sequence
  Peptide Derived from Human Papillomavirus
NAGVDNRECISMDYK

SEQ ID NO: 46596 - protein, 15 aa, Artificial Sequence
  Peptide Derived from Human Papillomavirus
NIYYHAGTSRLLAVG

SEQ ID NO: 46597 - protein, 15 aa, Artificial Sequence
  Peptide Derived from Human Papillomavirus
NKILVPKVSGLQYRV

SEQ ID NO: 46598 - protein, 15 aa, Artificial Sequence
  Peptide Derived from Human Papillomavirus
NKPYWLQRAQGHNNG

SEQ ID NO: 46599 - protein, 15 aa, Artificial Sequence
  Peptide Derived from Human Papillomavirus
NMSLCAAISTSETTY

SEQ ID NO: 46600 - protein, 15 aa, Artificial Sequence
  Peptide Derived from Human Papillomavirus
NNKILVPKVSGLQYR

SEQ ID NO: 46601 - protein, 15 aa, Artificial Sequence
  Peptide Derived from Human Papillomavirus
NTVIQDGDMVDTGFG

SEQ ID NO: 46602 - protein, 15 aa, Artificial Sequence
  Peptide Derived from Human Papillomavirus
NVAVNPGDCPPLELI

SEQ ID NO: 46603 - protein, 15 aa, Artificial Sequence
  Peptide Derived from Human Papillomavirus
PDDLYIKGSGSTANL

SEQ ID NO: 46604 - protein, 15 aa, Artificial Sequence
  Peptide Derived from Human Papillomavirus
PLDICTSICKYPDYI

SEQ ID NO: 46605 - protein, 15 aa, Artificial Sequence
  Peptide Derived from Human Papillomavirus
PLELINTVIQDGDMV

SEQ ID NO: 46606 - protein, 15 aa, Artificial Sequence
  Peptide Derived from Human Papillomavirus
PNKFGFPDTSFYNPD

SEQ ID NO: 46607 - protein, 15 aa, Artificial Sequence
  Peptide Derived from Human Papillomavirus
PVPVSKVVSTDEYVA

SEQ ID NO: 46608 - protein, 15 aa, Artificial Sequence
  Peptide Derived from Human Papillomavirus
QFIFQLCKITLTADV

SEQ ID NO: 46609 - protein, 15 aa, Artificial Sequence
  Peptide Derived from Human Papillomavirus
QFPLGRKFLLQAGLK

SEQ ID NO: 46610 - protein, 15 aa, Artificial Sequence
  Peptide Derived from Human Papillomavirus
QLCLIGCKPPIGEHW

SEQ ID NO: 46611 - protein, 15 aa, Artificial Sequence
  Peptide Derived from Human Papillomavirus
QLFVTVVDTTRSTNM

SEQ ID NO: 46612 - protein, 15 aa, Artificial Sequence
  Peptide Derived from Human Papillomavirus
QTQLCLIGCKPPIGE

SEQ ID NO: 46613 - protein, 15 aa, Artificial Sequence
  Peptide Derived from Human Papillomavirus
QVTFIYILVITCYEN

SEQ ID NO: 46614 - protein, 15 aa, Artificial Sequence
  Peptide Derived from Human Papillomavirus
QYRVFRIHLPDPNKF

SEQ ID NO: 46615 - protein, 15 aa, Artificial Sequence
  Peptide Derived from Human Papillomavirus
REQMFVRHLFNRAGA

SEQ ID NO: 46616 - protein, 15 aa, Artificial Sequence
  Peptide Derived from Human Papillomavirus
RHLFNRAGAVGENVP

SEQ ID NO: 46617 - protein, 15 aa, Artificial Sequence
  Peptide Derived from Human Papillomavirus
RKFLLQAGLKAKPKF

SEQ ID NO: 46618 - protein, 15 aa, Artificial Sequence
  Peptide Derived from Human Papillomavirus
RLVWACVGVEVGRGQ

SEQ ID NO: 46619 - protein, 15 aa, Artificial Sequence
  Peptide Derived from Human Papillomavirus
SADLDQFPLGRKFLL

SEQ ID NO: 46620 - protein, 15 aa, Artificial Sequence
  Peptide Derived from Human Papillomavirus
SGSMVTSDAQIFNKP

SEQ ID NO: 46621 - protein, 15 aa, Artificial Sequence
  Peptide Derived from Human Papillomavirus
SLWLPSEATVYLPPV

SEQ ID NO: 46622 - protein, 15 aa, Artificial Sequence
  Peptide Derived from Human Papillomavirus
SMDYKQTQLCLIGCK

SEQ ID NO: 46623 - protein, 15 aa, Artificial Sequence
  Peptide Derived from Human Papillomavirus
SRLLAVGHPYFPIKK

SEQ ID NO: 46624 - protein, 15 aa, Artificial Sequence
  Peptide Derived from Human Papillomavirus
SSNYFPTPSGSMVTS

SEQ ID NO: 46625 - protein, 15 aa, Artificial Sequence
  Peptide Derived from Human Papillomavirus
STNMSLCAAISTSET

SEQ ID NO: 46626 - protein, 15 aa, Artificial Sequence
  Peptide Derived from Human Papillomavirus
TFIYILVITCYENDV

SEQ ID NO: 46627 - protein, 15 aa, Artificial Sequence
  Peptide Derived from Human Papillomavirus
TNIYYHAGTSRLLAV

SEQ ID NO: 46628 - protein, 15 aa, Artificial Sequence
  Peptide Derived from Human Papillomavirus
TQRLVWACVGVEVGR

SEQ ID NO: 46629 - protein, 15 aa, Artificial Sequence
  Peptide Derived from Human Papillomavirus
TVYLPPVPVSKVVST

SEQ ID NO: 46630 - protein, 15 aa, Artificial Sequence
  Peptide Derived from Human Papillomavirus
TYRFVTSQAIACQKH

SEQ ID NO: 46631 - protein, 15 aa, Artificial Sequence
  Peptide Derived from Human Papillomavirus
VFRIHLPDPNKFGFP

SEQ ID NO: 46632 - protein, 15 aa, Artificial Sequence
  Peptide Derived from Human Papillomavirus
VTFIYILVITCYEND

SEQ ID NO: 46633 - protein, 15 aa, Artificial Sequence
  Peptide Derived from Human Papillomavirus
VTVVDTTRSTNMSLC

SEQ ID NO: 46634 - protein, 15 aa, Artificial Sequence
  Peptide Derived from Human Papillomavirus
VYHIFFQMSLWLPSE

SEQ ID NO: 46635 - protein, 15 aa, Artificial Sequence
  Peptide Derived from Human Papillomavirus
YHIFFQMSLWLPSEA

SEQ ID NO: 46636 - protein, 15 aa, Artificial Sequence
  Peptide Derived from Human Papillomavirus
YPDYIKMVSEPYGDS

SEQ ID NO: 46637 - protein, 15 aa, Artificial Sequence
  Peptide Derived from Human Papillomavirus
YRFVTSQAIACQKHT

SEQ ID NO: 46638 - protein, 15 aa, Artificial Sequence
  Peptide Derived from Human Papillomavirus
YRVFRIHLPDPNKFG

SEQ ID NO: 46639 - protein, 15 aa, Artificial Sequence
  Peptide Derived from Human Papillomavirus
  VARIANT 1, 2, 3: Xaa= Any amino acid
XXXMRHKRSAKRTKR

SEQ ID NO: 46640 - protein, 15 aa, Artificial Sequence
  Peptide Derived from Human Papillomavirus
ADDFITDTSTTPVPS

SEQ ID NO: 46641 - protein, 15 aa, Artificial Sequence
  Peptide Derived from Human Papillomavirus
ADQILQYGSMGVFFG

SEQ ID NO: 46642 - protein, 15 aa, Artificial Sequence
  Peptide Derived from Human Papillomavirus
AEEIELQTITPSTYT

SEQ ID NO: 46643 - protein, 15 aa, Artificial Sequence
  Peptide Derived from Human Papillomavirus
AGDFYLHPSYYMLRK

SEQ ID NO: 46644 - protein, 15 aa, Artificial Sequence
  Peptide Derived from Human Papillomavirus
APSLIPIVPGSPQYT

SEQ ID NO: 46645 - protein, 15 aa, Artificial Sequence
  Peptide Derived from Human Papillomavirus
DDFITDTSTTPVPSV

SEQ ID NO: 46646 - protein, 15 aa, Artificial Sequence
  Peptide Derived from Human Papillomavirus
DPAFITTPTKLITYD

SEQ ID NO: 46647 - protein, 15 aa, Artificial Sequence
  Peptide Derived from Human Papillomavirus
DPDFLDIVALHRPAL

SEQ ID NO: 46648 - protein, 15 aa, Artificial Sequence
  Peptide Derived from Human Papillomavirus
DPSVLQPPTPAETGG

SEQ ID NO: 46649 - protein, 15 aa, Artificial Sequence
  Peptide Derived from Human Papillomavirus
DQILQYGSMGVFFGG

SEQ ID NO: 46650 - protein, 15 aa, Artificial Sequence
  Peptide Derived from Human Papillomavirus
DTFIVSTNPNTVTSS

SEQ ID NO: 46651 - protein, 15 aa, Artificial Sequence
  Peptide Derived from Human Papillomavirus
EIELQTITPSTYTTT

SEQ ID NO: 46652 - protein, 15 aa, Artificial Sequence
  Peptide Derived from Human Papillomavirus
EIPMDTFIVSTNPNT

SEQ ID NO: 46653 - protein, 15 aa, Artificial Sequence
  Peptide Derived from Human Papillomavirus
ETSFIDAGAPTSVPS

SEQ ID NO: 46654 - protein, 15 aa, Artificial Sequence
  Peptide Derived from Human Papillomavirus
GGAYNIPLVSGPDIP

SEQ ID NO: 46655 - protein, 15 aa, Artificial Sequence
  Peptide Derived from Human Papillomavirus
GGHFTLSSSTISTHN

SEQ ID NO: 46656 - protein, 15 aa, Artificial Sequence
  Peptide Derived from Human Papillomavirus
GKTIADQILQYGSMG

SEQ ID NO: 46657 - protein, 15 aa, Artificial Sequence
  Peptide Derived from Human Papillomavirus
GPDIPINITDQAPSL

SEQ ID NO: 46658 - protein, 15 aa, Artificial Sequence
  Peptide Derived from Human Papillomavirus
GVFFGGLGIGTGSGT

SEQ ID NO: 46659 - protein, 15 aa, Artificial Sequence
  Peptide Derived from Human Papillomavirus
HFTLSSSTISTHNYE

SEQ ID NO: 46660 - protein, 15 aa, Artificial Sequence
  Peptide Derived from Human Papillomavirus
HYYYDFSTIDSAEEI

SEQ ID NO: 46661 - protein, 15 aa, Artificial Sequence
  Peptide Derived from Human Papillomavirus
ILDINNTVTTVTTHN

SEQ ID NO: 46662 - protein, 15 aa, Artificial Sequence
  Peptide Derived from Human Papillomavirus
ILQYGSMGVFFGGLG

SEQ ID NO: 46663 - protein, 15 aa, Artificial Sequence
  Peptide Derived from Human Papillomavirus
IPKVEGKTIADQILQ

SEQ ID NO: 46664 - protein, 15 aa, Artificial Sequence
  Peptide Derived from Human Papillomavirus
IPLVSGPDIPINITD

SEQ ID NO: 46665 - protein, 15 aa, Artificial Sequence
  Peptide Derived from Human Papillomavirus
IVALHRPALTSRRTG

SEQ ID NO: 46666 - protein, 15 aa, Artificial Sequence
  Peptide Derived from Human Papillomavirus
IVSLVEETSFIDAGA

SEQ ID NO: 46667 - protein, 15 aa, Artificial Sequence
  Peptide Derived from Human Papillomavirus
KVHYYYDFSTIDSAE

SEQ ID NO: 46668 - protein, 15 aa, Artificial Sequence
  Peptide Derived from Human Papillomavirus
LAPVRPPLTVDPVGP

SEQ ID NO: 46669 - protein, 15 aa, Artificial Sequence
  Peptide Derived from Human Papillomavirus
LDIVALHRPALTSRR

SEQ ID NO: 46670 - protein, 15 aa, Artificial Sequence
  Peptide Derived from Human Papillomavirus
LIPIVPGSPQYTIIA

SEQ ID NO: 46671 - protein, 12 aa, Artificial Sequence
  Peptide Derived from Human Papillomavirus
LPYFFSDVSLAA

SEQ ID NO: 46672 - protein, 15 aa, Artificial Sequence
  Peptide Derived from Human Papillomavirus
LSGYIPANTTIPFGG

SEQ ID NO: 46673 - protein, 15 aa, Artificial Sequence
  Peptide Derived from Human Papillomavirus
NNGLYDIYADDFITD

SEQ ID NO: 46674 - protein, 15 aa, Artificial Sequence
  Peptide Derived from Human Papillomavirus
NNTVTTVTTHNNPTF

SEQ ID NO: 46675 - protein, 15 aa, Artificial Sequence
  Peptide Derived from Human Papillomavirus
NPAYEGIDVDNTLYF

SEQ ID NO: 46676 - protein, 15 aa, Artificial Sequence
  Peptide Derived from Human Papillomavirus
NPTFTDPSVLQPPTP

SEQ ID NO: 46677 - protein, 15 aa, Artificial Sequence
  Peptide Derived from Human Papillomavirus
NTTIPFGGAYNIPLV

SEQ ID NO: 46678 - protein, 15 aa, Artificial Sequence
  Peptide Derived from Human Papillomavirus
PAILDINNTVTTVTT

SEQ ID NO: 46679 - protein, 15 aa, Artificial Sequence
  Peptide Derived from Human Papillomavirus
PDFLDIVALHRPALT

SEQ ID NO: 46680 - protein, 15 aa, Artificial Sequence
  Peptide Derived from Human Papillomavirus
PINITDQAPSLIPIV

SEQ ID NO: 46681 - protein, 15 aa, Artificial Sequence
  Peptide Derived from Human Papillomavirus
PLTVDPVGPSDPSIV

SEQ ID NO: 46682 - protein, 15 aa, Artificial Sequence
  Peptide Derived from Human Papillomavirus
PNTVTSSTPIPGSRP

SEQ ID NO: 46683 - protein, 15 aa, Artificial Sequence
  Peptide Derived from Human Papillomavirus
PPDVSGFSITTSTDT

SEQ ID NO: 46684 - protein, 15 aa, Artificial Sequence
  Peptide Derived from Human Papillomavirus
PSVLQPPTPAETGGH

SEQ ID NO: 46685 - protein, 15 aa, Artificial Sequence
  Peptide Derived from Human Papillomavirus
PTSVPSIPPDVSGFS

SEQ ID NO: 46686 - protein, 15 aa, Artificial Sequence
  Peptide Derived from Human Papillomavirus
RKRLPYFFSDVSLAA

SEQ ID NO: 46687 - protein, 15 aa, Artificial Sequence
  Peptide Derived from Human Papillomavirus
RLGLYSRTTQQVKVV

SEQ ID NO: 46688 - protein, 13 aa, Artificial Sequence
  Peptide Derived from Human Papillomavirus
RLPYFFSDVSLAA

SEQ ID NO: 46689 - protein, 15 aa, Artificial Sequence
  Peptide Derived from Human Papillomavirus
RPALTSRRTGIRYSR

SEQ ID NO: 46690 - protein, 15 aa, Artificial Sequence
  Peptide Derived from Human Papillomavirus
RPPLTVDPVGPSDPS

SEQ ID NO: 46691 - protein, 15 aa, Artificial Sequence
  Peptide Derived from Human Papillomavirus
RTGIRYSRIGNKQTL

SEQ ID NO: 46692 - protein, 15 aa, Artificial Sequence
  Peptide Derived from Human Papillomavirus
RTGYIPLGTRPPTAT

SEQ ID NO: 46693 - protein, 15 aa, Artificial Sequence
  Peptide Derived from Human Papillomavirus
SGYIPANTTIPFGGA

SEQ ID NO: 46694 - protein, 15 aa, Artificial Sequence
  Peptide Derived from Human Papillomavirus
SMGVFFGGLGIGTGS

SEQ ID NO: 46695 - protein, 15 aa, Artificial Sequence
  Peptide Derived from Human Papillomavirus
SRPVARLGLYSRTTQ

SEQ ID NO: 46696 - protein, 15 aa, Artificial Sequence
  Peptide Derived from Human Papillomavirus
STPIPGSRPVARLGL

SEQ ID NO: 46697 - protein, 15 aa, Artificial Sequence
  Peptide Derived from Human Papillomavirus
STSLSGYIPANTTIP

SEQ ID NO: 46698 - protein, 15 aa, Artificial Sequence
  Peptide Derived from Human Papillomavirus
TDTLAPVRPPLTVDP

SEQ ID NO: 46699 - protein, 15 aa, Artificial Sequence
  Peptide Derived from Human Papillomavirus
THNYEEIPMDTFIVS

SEQ ID NO: 46700 - protein, 15 aa, Artificial Sequence
  Peptide Derived from Human Papillomavirus
TKLITYDNPAYEGID

SEQ ID NO: 46701 - protein, 15 aa, Artificial Sequence
  Peptide Derived from Human Papillomavirus
TQQVKVVDPAFITTP

SEQ ID NO: 46702 - protein, 15 aa, Artificial Sequence
  Peptide Derived from Human Papillomavirus
TSFIDAGAPTSVPSI

SEQ ID NO: 46703 - protein, 15 aa, Artificial Sequence
  Peptide Derived from Human Papillomavirus
TTPVPSVPSTSLSGY

SEQ ID NO: 46704 - protein, 15 aa, Artificial Sequence
  Peptide Derived from Human Papillomavirus
VDPVGPSDPSIVSLV

SEQ ID NO: 46705 - protein, 15 aa, Artificial Sequence
  Peptide Derived from Human Papillomavirus
VHYYYDFSTIDSAEE

SEQ ID NO: 46706 - protein, 15 aa, Artificial Sequence
  Peptide Derived from Human Papillomavirus
VKVVDPAFITTPTKL

SEQ ID NO: 46707 - protein, 15 aa, Artificial Sequence
  Peptide Derived from Human Papillomavirus
VPSIPPDVSGFSITT

SEQ ID NO: 46708 - protein, 15 aa, Artificial Sequence
  Peptide Derived from Human Papillomavirus
VPSVPSTSLSGYIPA

SEQ ID NO: 46709 - protein, 15 aa, Artificial Sequence
  Peptide Derived from Human Papillomavirus
VSGFSITTSTDTTPA

SEQ ID NO: 46710 - protein, 15 aa, Artificial Sequence
  Peptide Derived from Human Papillomavirus
YDIYADDFITDTSTT

SEQ ID NO: 46711 - protein, 15 aa, Artificial Sequence
  Peptide Derived from Human Papillomavirus
YEGIDVDNTLYFSSN

SEQ ID NO: 46712 - protein, 15 aa, Artificial Sequence
  Peptide Derived from Human Papillomavirus
YIPLGTRPPTATDTL

SEQ ID NO: 46713 - protein, 15 aa, Artificial Sequence
  Peptide Derived from Human Papillomavirus
YSRIGNKQTLRTRSG

SEQ ID NO: 46714 - protein, 15 aa, Artificial Sequence
  Peptide Derived from Human Papillomavirus
YYDFSTIDSAEEIEL

SEQ ID NO: 46715 - protein, 15 aa, Artificial Sequence
  Peptide Derived from Human Papillomavirus
AAAFLKSNCQAKYLK

SEQ ID NO: 46716 - protein, 15 aa, Artificial Sequence
  Peptide Derived from Human Papillomavirus
AKYLKDCATMCKHYR

SEQ ID NO: 46717 - protein, 15 aa, Artificial Sequence
  Peptide Derived from Human Papillomavirus
ALYWYRTGISNISEV

SEQ ID NO: 46718 - protein, 15 aa, Artificial Sequence
  Peptide Derived from Human Papillomavirus
CMLIQPPKLRSSVAA

SEQ ID NO: 46719 - protein, 15 aa, Artificial Sequence
  Peptide Derived from Human Papillomavirus
CNGWFYVQAIVDKKT

SEQ ID NO: 46720 - protein, 15 aa, Artificial Sequence
  Peptide Derived from Human Papillomavirus
CSEVEATQIQVTTNG

SEQ ID NO: 46721 - protein, 15 aa, Artificial Sequence
  Peptide Derived from Human Papillomavirus
CWTYFDTYMRNALDG

SEQ ID NO: 46722 - protein, 15 aa, Artificial Sequence
  Peptide Derived from Human Papillomavirus
DCKWGVLILALLRYK

SEQ ID NO: 46723 - protein, 15 aa, Artificial Sequence
  Peptide Derived from Human Papillomavirus
DMAFEYALLADSNSN

SEQ ID NO: 46724 - protein, 15 aa, Artificial Sequence
  Peptide Derived from Human Papillomavirus
DNRWPYLESRITVFE

SEQ ID NO: 46725 - protein, 15 aa, Artificial Sequence
  Peptide Derived from Human Papillomavirus
DSGYGCSEVEATQIQ

SEQ ID NO: 46726 - protein, 15 aa, Artificial Sequence
  Peptide Derived from Human Papillomavirus
DSNFDLSEMVQWAFD

SEQ ID NO: 46727 - protein, 15 aa, Artificial Sequence
  Peptide Derived from Human Papillomavirus
ERTWSRLDLHEEEED

SEQ ID NO: 46728 - protein, 15 aa, Artificial Sequence
  Peptide Derived from Human Papillomavirus
ESDMAFEYALLADSN

SEQ ID NO: 46729 - protein, 15 aa, Artificial Sequence
  Peptide Derived from Human Papillomavirus
ETCMLIQPPKLRSSV

SEQ ID NO: 46730 - protein, 15 aa, Artificial Sequence
  Peptide Derived from Human Papillomavirus
FDTYMRNALDGNPIS

SEQ ID NO: 46731 - protein, 15 aa, Artificial Sequence
  Peptide Derived from Human Papillomavirus
FIHFIQGAVISFVNS

SEQ ID NO: 46732 - protein, 15 aa, Artificial Sequence
  Peptide Derived from Human Papillomavirus
FILYAHIQCLDCKWG

SEQ ID NO: 46733 - protein, 15 aa, Artificial Sequence
  Peptide Derived from Human Papillomavirus
FKTLIQPFILYAHIQ

SEQ ID NO: 46734 - protein, 15 aa, Artificial Sequence
  Peptide Derived from Human Papillomavirus
GAVISFVNSTSHFWL

SEQ ID NO: 46735 - protein, 15 aa, Artificial Sequence
  Peptide Derived from Human Papillomavirus
GGNVCSGGSTEAIDN

SEQ ID NO: 46736 - protein, 15 aa, Artificial Sequence
  Peptide Derived from Human Papillomavirus
GNPFGTFKLRAGQNH

SEQ ID NO: 46737 - protein, 15 aa, Artificial Sequence
  Peptide Derived from Human Papillomavirus
GWFYVQAIVDKKTGD

SEQ ID NO: 46738 - protein, 15 aa, Artificial Sequence
  Peptide Derived from Human Papillomavirus
HKPLIQLKCPPILLT

SEQ ID NO: 46739 - protein, 15 aa, Artificial Sequence
  Peptide Derived from Human Papillomavirus
IEFITFLGALKSFLK

SEQ ID NO: 46740 - protein, 15 aa, Artificial Sequence
  Peptide Derived from Human Papillomavirus
IENVNPQCTIAQLKD

SEQ ID NO: 46741 - protein, 15 aa, Artificial Sequence
  Peptide Derived from Human Papillomavirus
IFGVNPTIAEGFKTL

SEQ ID NO: 46742 - protein, 15 aa, Artificial Sequence
  Peptide Derived from Human Papillomavirus
IHFIQGAVISFVNST

SEQ ID NO: 46743 - protein, 15 aa, Artificial Sequence
  Peptide Derived from Human Papillomavirus
ILALLRYKCGKSRLT

SEQ ID NO: 46744 - protein, 15 aa, Artificial Sequence
  Peptide Derived from Human Papillomavirus
ISEVMGDTPEWIQRL

SEQ ID NO: 46745 - protein, 15 aa, Artificial Sequence
  Peptide Derived from Human Papillomavirus
ITFLGALKSFLKGTP

SEQ ID NO: 46746 - protein, 15 aa, Artificial Sequence
  Peptide Derived from Human Papillomavirus
ITVFEFPNAFPFDKN

SEQ ID NO: 46747 - protein, 15 aa, Artificial Sequence
  Peptide Derived from Human Papillomavirus
KCFFERTWSRLDLHE

SEQ ID NO: 46748 - protein, 15 aa, Artificial Sequence
  Peptide Derived from Human Papillomavirus
KDTYGLSFTDLVRNF

SEQ ID NO: 46749 - protein, 15 aa, Artificial Sequence
  Peptide Derived from Human Papillomavirus
KNCLVFCGPANTGKS

SEQ ID NO: 46750 - protein, 15 aa, Artificial Sequence
  Peptide Derived from Human Papillomavirus
KPLIQLKCPPILLTT

SEQ ID NO: 46751 - protein, 15 aa, Artificial Sequence
  Peptide Derived from Human Papillomavirus
KRKFAGGSTENSPLG

SEQ ID NO: 46752 - protein, 15 aa, Artificial Sequence
  Peptide Derived from Human Papillomavirus
KSYFGMSFIHFIQGA

SEQ ID NO: 46753 - protein, 15 aa, Artificial Sequence
  Peptide Derived from Human Papillomavirus
KTLIQPFILYAHIQC

SEQ ID NO: 46754 - protein, 15 aa, Artificial Sequence
  Peptide Derived from Human Papillomavirus
KVAMLDDATTTCWTY

SEQ ID NO: 46755 - protein, 15 aa, Artificial Sequence
  Peptide Derived from Human Papillomavirus
KWGVLILALLRYKCG

SEQ ID NO: 46756 - protein, 15 aa, Artificial Sequence
  Peptide Derived from Human Papillomavirus
LEPLTDTKVAMLDDA

SEQ ID NO: 46757 - protein, 15 aa, Artificial Sequence
  Peptide Derived from Human Papillomavirus
LHVLKRKFAGGSTEN

SEQ ID NO: 46758 - protein, 15 aa, Artificial Sequence
  Peptide Derived from Human Papillomavirus
LIQLKCPPILLTTNI

SEQ ID NO: 46759 - protein, 15 aa, Artificial Sequence
  Peptide Derived from Human Papillomavirus
LKSFLKGTPKKNCLV

SEQ ID NO: 46760 - protein, 15 aa, Artificial Sequence
  Peptide Derived from Human Papillomavirus
LLHVPETCMLIQPPK

SEQ ID NO: 46761 - protein, 15 aa, Artificial Sequence
  Peptide Derived from Human Papillomavirus
LLRYKCGKSRLTVAK

SEQ ID NO: 46762 - protein, 15 aa, Artificial Sequence
  Peptide Derived from Human Papillomavirus
LYWYRTGISNISEVM

SEQ ID NO: 46763 - protein, 15 aa, Artificial Sequence
  Peptide Derived from Human Papillomavirus
MSQWIRFRCSKIDEG

SEQ ID NO: 46764 - protein, 15 aa, Artificial Sequence
  Peptide Derived from Human Papillomavirus
NCLVFCGPANTGKSY

SEQ ID NO: 46765 - protein, 15 aa, Artificial Sequence
  Peptide Derived from Human Papillomavirus
NGWFYVQAIVDKKTG

SEQ ID NO: 46766 - protein, 15 aa, Artificial Sequence
  Peptide Derived from Human Papillomavirus
NSNIENVNPQCTIAQ

SEQ ID NO: 46767 - protein, 15 aa, Artificial Sequence
  Peptide Derived from Human Papillomavirus
PEWIQRLTIIQHGID

SEQ ID NO: 46768 - protein, 15 aa, Artificial Sequence
  Peptide Derived from Human Papillomavirus
PPILLTTNIHPAKDN

SEQ ID NO: 46769 - protein, 15 aa, Artificial Sequence
  Peptide Derived from Human Papillomavirus
PPKLRSSVAALYWYR

SEQ ID NO: 46770 - protein, 15 aa, Artificial Sequence
  Peptide Derived from Human Papillomavirus
QAELETAQALFHAQE

SEQ ID NO: 46771 - protein, 15 aa, Artificial Sequence
  Peptide Derived from Human Papillomavirus
QAKYLKDCATMCKHY

SEQ ID NO: 46772 - protein, 15 aa, Artificial Sequence
  Peptide Derived from Human Papillomavirus
QALFHAQEVHNDAQV

SEQ ID NO: 46773 - protein, 15 aa, Artificial Sequence
  Peptide Derived from Human Papillomavirus
QPFILYAHIQCLDCK

SEQ ID NO: 46774 - protein, 15 aa, Artificial Sequence
  Peptide Derived from Human Papillomavirus
QWAFDNELTDESDMA

SEQ ID NO: 46775 - protein, 15 aa, Artificial Sequence
  Peptide Derived from Human Papillomavirus
RLEVDTELSPRLQEI

SEQ ID NO: 46776 - protein, 15 aa, Artificial Sequence
  Peptide Derived from Human Papillomavirus
RLTIIQHGIDDSNFD

SEQ ID NO: 46777 - protein, 15 aa, Artificial Sequence
  Peptide Derived from Human Papillomavirus
RLTVAKGLSTLLHVP

SEQ ID NO: 46778 - protein, 15 aa, Artificial Sequence
  Peptide Derived from Human Papillomavirus
RNALDGNPISIDRKH

SEQ ID NO: 46779 - protein, 15 aa, Artificial Sequence
  Peptide Derived from Human Papillomavirus
RRLFTISDSGYGCSE

SEQ ID NO: 46780 - protein, 15 aa, Artificial Sequence
  Peptide Derived from Human Papillomavirus
RWPYLESRITVFEFP

SEQ ID NO: 46781 - protein, 15 aa, Artificial Sequence
  Peptide Derived from Human Papillomavirus
SDMVDFIDTQGTFCE

SEQ ID NO: 46782 - protein, 15 aa, Artificial Sequence
  Peptide Derived from Human Papillomavirus
SHFWLEPLTDTKVAM

SEQ ID NO: 46783 - protein, 15 aa, Artificial Sequence
  Peptide Derived from Human Papillomavirus
SPRLQEISLNSGQKK

SEQ ID NO: 46784 - protein, 15 aa, Artificial Sequence
  Peptide Derived from Human Papillomavirus
SQWIRFRCSKIDEGG

SEQ ID NO: 46785 - protein, 15 aa, Artificial Sequence
  Peptide Derived from Human Papillomavirus
STLLHVPETCMLIQP

SEQ ID NO: 46786 - protein, 15 aa, Artificial Sequence
  Peptide Derived from Human Papillomavirus
TAIFGVNPTIAEGFK

SEQ ID NO: 46787 - protein, 15 aa, Artificial Sequence
  Peptide Derived from Human Papillomavirus
TDLVRNFKSDKTTCT

SEQ ID NO: 46788 - protein, 15 aa, Artificial Sequence
  Peptide Derived from Human Papillomavirus
TEAIDNGGTEGNNSS

SEQ ID NO: 46789 - protein, 15 aa, Artificial Sequence
  Peptide Derived from Human Papillomavirus
TPEWIQRLTIIQHGI

SEQ ID NO: 46790 - protein, 15 aa, Artificial Sequence
  Peptide Derived from Human Papillomavirus
TSHFWLEPLTDTKVA

SEQ ID NO: 46791 - protein, 15 aa, Artificial Sequence
  Peptide Derived from Human Papillomavirus
TTCWTYFDTYMRNAL

SEQ ID NO: 46792 - protein, 15 aa, Artificial Sequence
  Peptide Derived from Human Papillomavirus
TYGLSFTDLVRNFKS

SEQ ID NO: 46793 - protein, 15 aa, Artificial Sequence
  Peptide Derived from Human Papillomavirus
VAALYWYRTGISNIS

SEQ ID NO: 46794 - protein, 15 aa, Artificial Sequence
  Peptide Derived from Human Papillomavirus
VAMLDDATTTCWTYF

SEQ ID NO: 46795 - protein, 15 aa, Artificial Sequence
  Peptide Derived from Human Papillomavirus
VDFIDTQGTFCEQAE

SEQ ID NO: 46796 - protein, 15 aa, Artificial Sequence
  Peptide Derived from Human Papillomavirus
VFEFPNAFPFDKNGN

SEQ ID NO: 46797 - protein, 15 aa, Artificial Sequence
  Peptide Derived from Human Papillomavirus
VISFVNSTSHFWLEP

SEQ ID NO: 46798 - protein, 15 aa, Artificial Sequence
  Peptide Derived from Human Papillomavirus
VQAIVDKKTGDVISD

SEQ ID NO: 46799 - protein, 15 aa, Artificial Sequence
  Peptide Derived from Human Papillomavirus
VQFLRYQQIEFITFL

SEQ ID NO: 46800 - protein, 15 aa, Artificial Sequence
  Peptide Derived from Human Papillomavirus
VRNFKSDKTTCTDWV

SEQ ID NO: 46801 - protein, 15 aa, Artificial Sequence
  Peptide Derived from Human Papillomavirus
VTAIFGVNPTIAEGF

SEQ ID NO: 46802 - protein, 15 aa, Artificial Sequence
  Peptide Derived from Human Papillomavirus
WGVLILALLRYKCGK

SEQ ID NO: 46803 - protein, 15 aa, Artificial Sequence
  Peptide Derived from Human Papillomavirus
WIRFRCSKIDEGGDW

SEQ ID NO: 46804 - protein, 15 aa, Artificial Sequence
  Peptide Derived from Human Papillomavirus
WPYLESRITVFEFPN

SEQ ID NO: 46805 - protein, 15 aa, Artificial Sequence
  Peptide Derived from Human Papillomavirus
YAHIQCLDCKWGVLI

SEQ ID NO: 46806 - protein, 15 aa, Artificial Sequence
  Peptide Derived from Human Papillomavirus
YALLADSNSNAAAFL

SEQ ID NO: 46807 - protein, 15 aa, Artificial Sequence
  Peptide Derived from Human Papillomavirus
AGTWDKTATCVSHRG

SEQ ID NO: 46808 - protein, 15 aa, Artificial Sequence
  Peptide Derived from Human Papillomavirus
AKTYGQTSAATRPGH

SEQ ID NO: 46809 - protein, 15 aa, Artificial Sequence
  Peptide Derived from Human Papillomavirus
ATCVSHRGLYYVKEG

SEQ ID NO: 46810 - protein, 15 aa, Artificial Sequence
  Peptide Derived from Human Papillomavirus
AYNISKSKAHKAIEL

SEQ ID NO: 46811 - protein, 15 aa, Artificial Sequence
  Peptide Derived from Human Papillomavirus
CEELWNTEPTHCFKK

SEQ ID NO: 46812 - protein, 15 aa, Artificial Sequence
  Peptide Derived from Human Papillomavirus
CEKYGNTGTWEVHFG

SEQ ID NO: 46813 - protein, 15 aa, Artificial Sequence
  Peptide Derived from Human Papillomavirus
CMTYVAWDSVYYMTD

SEQ ID NO: 46814 - protein, 15 aa, Artificial Sequence
  Peptide Derived from Human Papillomavirus
DDTVSATQLVKQLQH

SEQ ID NO: 46815 - protein, 15 aa, Artificial Sequence
  Peptide Derived from Human Papillomavirus
DSQIQYWQLIRWENA

SEQ ID NO: 46816 - protein, 15 aa, Artificial Sequence
  Peptide Derived from Human Papillomavirus
DSVYYMTDAGTWDKT

SEQ ID NO: 46817 - protein, 15 aa, Artificial Sequence
  Peptide Derived from Human Papillomavirus
EELWNTEPTHCFKKG

SEQ ID NO: 46818 - protein, 15 aa, Artificial Sequence
  Peptide Derived from Human Papillomavirus
ELQMALQGLAQSRYK

SEQ ID NO: 46819 - protein, 15 aa, Artificial Sequence
  Peptide Derived from Human Papillomavirus
EVHFGNNVIDCNDSM

SEQ ID NO: 46820 - protein, 15 aa, Artificial Sequence
  Peptide Derived from Human Papillomavirus
HKAIELQMALQGLAQ

SEQ ID NO: 46821 - protein, 15 aa, Artificial Sequence
  Peptide Derived from Human Papillomavirus
HQVVPAYNISKSKAH

SEQ ID NO: 46822 - protein, 15 aa, Artificial Sequence
  Peptide Derived from Human Papillomavirus
IQTLNHQVVPAYNIS

SEQ ID NO: 46823 - protein, 15 aa, Artificial Sequence
  Peptide Derived from Human Papillomavirus
KEGYNTFYIEFKSEC

SEQ ID NO: 46824 - protein, 15 aa, Artificial Sequence
  Peptide Derived from Human Papillomavirus
KETLSERLSCVQDKI

SEQ ID NO: 46825 - protein, 15 aa, Artificial Sequence
  Peptide Derived from Human Papillomavirus
LNTVAIPDSVQILVG

SEQ ID NO: 46826 - protein, 15 aa, Artificial Sequence
  Peptide Derived from Human Papillomavirus
LSCVQDKIIDHYEND

SEQ ID NO: 46827 - protein, 15 aa, Artificial Sequence
  Peptide Derived from Human Papillomavirus
MTYVAWDSVYYMTDA

SEQ ID NO: 46828 - protein, 15 aa, Artificial Sequence
  Peptide Derived from Human Papillomavirus
NNVIDCNDSMCSTSD

SEQ ID NO: 46829 - protein, 15 aa, Artificial Sequence
  Peptide Derived from Human Papillomavirus
NPLLGAATPTGNNKR

SEQ ID NO: 46830 - protein, 15 aa, Artificial Sequence
  Peptide Derived from Human Papillomavirus
NTFYIEFKSECEKYG

SEQ ID NO: 46831 - protein, 15 aa, Artificial Sequence
  Peptide Derived from Human Papillomavirus
PSPYSSTVSVGTAKT

SEQ ID NO: 46832 - protein, 15 aa, Artificial Sequence
  Peptide Derived from Human Papillomavirus
RRKLCSGNTTPIIHL

SEQ ID NO: 46833 - protein, 15 aa, Artificial Sequence
  Peptide Derived from Human Papillomavirus
RTKFLNTVAIPDSVQ

SEQ ID NO: 46834 - protein, 15 aa, Artificial Sequence
  Peptide Derived from Human Papillomavirus
SDHYRDISSTWHWTG

SEQ ID NO: 46835 - protein, 15 aa, Artificial Sequence
  Peptide Derived from Human Papillomavirus
SSTVSVGTAKTYGQT

SEQ ID NO: 46836 - protein, 15 aa, Artificial Sequence
  Peptide Derived from Human Papillomavirus
SSTWHWTGAGNEKTG

SEQ ID NO: 46837 - protein, 15 aa, Artificial Sequence
  Peptide Derived from Human Papillomavirus
TEDWTLQDTCEELWN

SEQ ID NO: 46838 - protein, 15 aa, Artificial Sequence
  Peptide Derived from Human Papillomavirus
TKFLNTVAIPDSVQI

SEQ ID NO: 46839 - protein, 15 aa, Artificial Sequence
  Peptide Derived from Human Papillomavirus
TVSVGTAKTYGQTSA

SEQ ID NO: 46840 - protein, 15 aa, Artificial Sequence
  Peptide Derived from Human Papillomavirus
VKQLQHTPSPYSSTV

SEQ ID NO: 46841 - protein, 15 aa, Artificial Sequence
  Peptide Derived from Human Papillomavirus
VNPLLGAATPTGNNK

SEQ ID NO: 46842 - protein, 15 aa, Artificial Sequence
  Peptide Derived from Human Papillomavirus
VPAYNISKSKAHKAI

SEQ ID NO: 46843 - protein, 15 aa, Artificial Sequence
  Peptide Derived from Human Papillomavirus
VYYMTDAGTWDKTAT

SEQ ID NO: 46844 - protein, 15 aa, Artificial Sequence
  Peptide Derived from Human Papillomavirus
WQLIRWENAIFFAAR

SEQ ID NO: 46845 - protein, 15 aa, Artificial Sequence
  Peptide Derived from Human Papillomavirus
  VARIANT 1, 2: Xaa= Any amino acid
XXMLSLIFLFCFCVC

SEQ ID NO: 46846 - protein, 15 aa, Artificial Sequence
  Peptide Derived from Human Papillomavirus
AWVLVFVYIVVITSP

SEQ ID NO: 46847 - protein, 15 aa, Artificial Sequence
  Peptide Derived from Human Papillomavirus
AYAWVLVFVYIVVIT

SEQ ID NO: 46848 - protein, 15 aa, Artificial Sequence
  Peptide Derived from Human Papillomavirus
CCHVPLLPSVCMCAY

SEQ ID NO: 46849 - protein, 15 aa, Artificial Sequence
  Peptide Derived from Human Papillomavirus
CFCVCMYVCCHVPLL

SEQ ID NO: 46850 - protein, 15 aa, Artificial Sequence
  Peptide Derived from Human Papillomavirus
CFLLPMLLLHIHAIL

SEQ ID NO: 46851 - protein, 15 aa, Artificial Sequence
  Peptide Derived from Human Papillomavirus
CMYVCCHVPLLPSVC

SEQ ID NO: 46852 - protein, 15 aa, Artificial Sequence
  Peptide Derived from Human Papillomavirus
FCFLLPMLLLHIHAI

SEQ ID NO: 46853 - protein, 15 aa, Artificial Sequence
  Peptide Derived from Human Papillomavirus
FTVYVFCFLLPMLLL

SEQ ID NO: 46854 - protein, 15 aa, Artificial Sequence
  Peptide Derived from Human Papillomavirus
FVYIVVITSPATAFT

SEQ ID NO: 46855 - protein, 15 aa, Artificial Sequence
  Peptide Derived from Human Papillomavirus
HVPLLPSVCMCAYAW

SEQ ID NO: 46856 - protein, 15 aa, Artificial Sequence
  Peptide Derived from Human Papillomavirus
IFLFCFCVCMYVCCH

SEQ ID NO: 46857 - protein, 15 aa, Artificial Sequence
  Peptide Derived from Human Papillomavirus
IVVITSPATAFTVYV

SEQ ID NO: 46858 - protein, 15 aa, Artificial Sequence
  Peptide Derived from Human Papillomavirus
LIFLFCFCVCMYVCC

SEQ ID NO: 46859 - protein, 15 aa, Artificial Sequence
  Peptide Derived from Human Papillomavirus
LLPMLLLHIHAILSL

SEQ ID NO: 46860 - protein, 15 aa, Artificial Sequence
  Peptide Derived from Human Papillomavirus
LVFVYIVVITSPATA

SEQ ID NO: 46861 - protein, 15 aa, Artificial Sequence
  Peptide Derived from Human Papillomavirus
MCAYAWVLVFVYIVV

SEQ ID NO: 46862 - protein, 13 aa, Artificial Sequence
  Peptide Derived from Human Papillomavirus
MLLLHIHAILSLQ

SEQ ID NO: 46863 - protein, 15 aa, Artificial Sequence
  Peptide Derived from Human Papillomavirus
MLSLIFLFCFCVCMY

SEQ ID NO: 46864 - protein, 14 aa, Artificial Sequence
  Peptide Derived from Human Papillomavirus
PMLLLHIHAILSLQ

SEQ ID NO: 46865 - protein, 15 aa, Artificial Sequence
  Peptide Derived from Human Papillomavirus
SLIFLFCFCVCMYVC

SEQ ID NO: 46866 - protein, 15 aa, Artificial Sequence
  Peptide Derived from Human Papillomavirus
TVYVFCFLLPMLLLH

SEQ ID NO: 46867 - protein, 15 aa, Artificial Sequence
  Peptide Derived from Human Papillomavirus
VCMYVCCHVPLLPSV

SEQ ID NO: 46868 - protein, 15 aa, Artificial Sequence
  Peptide Derived from Human Papillomavirus
VFCFLLPMLLLHIHA

SEQ ID NO: 46869 - protein, 15 aa, Artificial Sequence
  Peptide Derived from Human Papillomavirus
VFVYIVVITSPATAF

SEQ ID NO: 46870 - protein, 15 aa, Artificial Sequence
  Peptide Derived from Human Papillomavirus
VLVFVYIVVITSPAT

SEQ ID NO: 46871 - protein, 15 aa, Artificial Sequence
  Peptide Derived from Human Papillomavirus
VPLLPSVCMCAYAWV

SEQ ID NO: 46872 - protein, 15 aa, Artificial Sequence
  Peptide Derived from Human Papillomavirus
VYIVVITSPATAFTV

SEQ ID NO: 46873 - protein, 15 aa, Artificial Sequence
  Peptide Derived from Human Papillomavirus
VYVFCFLLPMLLLHI

SEQ ID NO: 46874 - protein, 15 aa, Artificial Sequence
  Peptide Derived from Human Papillomavirus
WVLVFVYIVVITSPA

SEQ ID NO: 46875 - protein, 15 aa, Artificial Sequence
  Peptide Derived from Human Papillomavirus
YIVVITSPATAFTVY

SEQ ID NO: 46876 - protein, 15 aa, Artificial Sequence
  Peptide Derived from Human Papillomavirus
DIEITCVYCKTVLEL

SEQ ID NO: 46877 - protein, 15 aa, Artificial Sequence
  Peptide Derived from Human Papillomavirus
DLFVVYRDSIPHAAC

SEQ ID NO: 46878 - protein, 15 aa, Artificial Sequence
  Peptide Derived from Human Papillomavirus
EFAFKDLFVVYRDSI

SEQ ID NO: 46879 - protein, 15 aa, Artificial Sequence
  Peptide Derived from Human Papillomavirus
FVVYRDSIPHAACHK

SEQ ID NO: 46880 - protein, 15 aa, Artificial Sequence
  Peptide Derived from Human Papillomavirus
IRCLRCQKPLNPAEK

SEQ ID NO: 46881 - protein, 15 aa, Artificial Sequence
  Peptide Derived from Human Papillomavirus
ITCVYCKTVLELTEV

SEQ ID NO: 46882 - protein, 15 aa, Artificial Sequence
  Peptide Derived from Human Papillomavirus
KTVLELTEVFEFAFK

SEQ ID NO: 46883 - protein, 15 aa, Artificial Sequence
  Peptide Derived from Human Papillomavirus
LEKLTNTGLYNLLIR

SEQ ID NO: 46884 - protein, 15 aa, Artificial Sequence
  Peptide Derived from Human Papillomavirus
LFVVYRDSIPHAACH

SEQ ID NO: 46885 - protein, 15 aa, Artificial Sequence
  Peptide Derived from Human Papillomavirus
LQDIEITCVYCKTVL

SEQ ID NO: 46886 - protein, 15 aa, Artificial Sequence
  Peptide Derived from Human Papillomavirus
LYNLLIRCLRCQKPL

SEQ ID NO: 46887 - protein, 15 aa, Artificial Sequence
  Peptide Derived from Human Papillomavirus
NLLIRCLRCQKPLNP

SEQ ID NO: 46888 - protein, 15 aa, Artificial Sequence
  Peptide Derived from Human Papillomavirus
NTGLYNLLIRCLRCQ

SEQ ID NO: 46889 - protein, 15 aa, Artificial Sequence
  Peptide Derived from Human Papillomavirus
NTSLQDIEITCVYCK

SEQ ID NO: 46890 - protein, 15 aa, Artificial Sequence
  Peptide Derived from Human Papillomavirus
PYKLPDLCTELNTSL

SEQ ID NO: 46891 - protein, 15 aa, Artificial Sequence
  Peptide Derived from Human Papillomavirus
RDSIPHAACHKCIDF

SEQ ID NO: 46892 - protein, 15 aa, Artificial Sequence
  Peptide Derived from Human Papillomavirus
RRPYKLPDLCTELNT

SEQ ID NO: 46893 - protein, 15 aa, Artificial Sequence
  Peptide Derived from Human Papillomavirus
SDSVYGDTLEKLTNT

SEQ ID NO: 46894 - protein, 15 aa, Artificial Sequence
  Peptide Derived from Human Papillomavirus
TCVYCKTVLELTEVF

SEQ ID NO: 46895 - protein, 15 aa, Artificial Sequence
  Peptide Derived from Human Papillomavirus
VFEFAFKDLFVVYRD

SEQ ID NO: 46896 - protein, 15 aa, Artificial Sequence
  Peptide Derived from Human Papillomavirus
  VARIANT 1, 2, 3: Xaa= Any amino acid
XXXMHGPKATLQDIV

SEQ ID NO: 46897 - protein, 15 aa, Artificial Sequence
  Peptide Derived from Human Papillomavirus
FQQLFLNTLSFVCPW

SEQ ID NO: 46898 - protein, 15 aa, Artificial Sequence
  Peptide Derived from Human Papillomavirus
HQHLPARRAEPQRHT

SEQ ID NO: 46899 - protein, 15 aa, Artificial Sequence
  Peptide Derived from Human Papillomavirus
IDGVNHQHLPARRAE

SEQ ID NO: 46900 - protein, 15 aa, Artificial Sequence
  Peptide Derived from Human Papillomavirus
IKLVVESSADDLRAF

SEQ ID NO: 46901 - protein, 15 aa, Artificial Sequence
  Peptide Derived from Human Papillomavirus
KATLQDIVLHLEPQN

SEQ ID NO: 46902 - protein, 15 aa, Artificial Sequence
  Peptide Derived from Human Papillomavirus
LNTLSFVCPWCASQQ

SEQ ID NO: 46903 - protein, 15 aa, Artificial Sequence
  Peptide Derived from Human Papillomavirus
LRAFQQLFLNTLSFV

SEQ ID NO: 46904 - protein, 12 aa, Artificial Sequence
  Peptide Derived from Human Papillomavirus
LSFVCPWCASQQ

SEQ ID NO: 46905 - protein, 15 aa, Artificial Sequence
  Peptide Derived from Human Papillomavirus
QDIVLHLEPQNEIPV

SEQ ID NO: 46906 - protein, 15 aa, Artificial Sequence
  Peptide Derived from Human Papillomavirus
QNEIPVDLLCHEQLS

SEQ ID NO: 46907 - protein, 15 aa, Artificial Sequence
  Peptide Derived from Human Papillomavirus
QQLFLNTLSFVCPWC

SEQ ID NO: 46908 - protein, 15 aa, Artificial Sequence
  Peptide Derived from Human Papillomavirus
RHTMLCMCCKCEARI

SEQ ID NO: 46909 - protein, 15 aa, Artificial Sequence
  Peptide Derived from Human Papillomavirus
RIKLVVESSADDLRA

SEQ ID NO: 46910 - protein, 13 aa, Artificial Sequence
  Peptide Derived from Human Papillomavirus
TLSFVCPWCASQQ

SEQ ID NO: 46911 - protein, 15 aa, Artificial Sequence
  Peptide Derived from Human Papillomavirus
VDLLCHEQLSDSEEE

SEQ ID NO: 46912 - protein, 15 aa, Artificial Sequence
  Peptide Derived from Human Papillomavirus
  VARIANT 1: Xaa= Any amino acid
XMCLYTRVLILHYHL

SEQ ID NO: 46913 - protein, 15 aa, Artificial Sequence
  Peptide Derived from Human Papillomavirus
ADVMSYIHSMNSSIL

SEQ ID NO: 46914 - protein, 15 aa, Artificial Sequence
  Peptide Derived from Human Papillomavirus
AGTMGDTVPQSLYIK

SEQ ID NO: 46915 - protein, 15 aa, Artificial Sequence
  Peptide Derived from Human Papillomavirus
APAIGEHWAKGTACK

SEQ ID NO: 46916 - protein, 15 aa, Artificial Sequence
  Peptide Derived from Human Papillomavirus
AYQYRVFRVQLPDPN

SEQ ID NO: 46917 - protein, 15 aa, Artificial Sequence
  Peptide Derived from Human Papillomavirus
CGHYIILFLRNVNVF

SEQ ID NO: 46918 - protein, 15 aa, Artificial Sequence
  Peptide Derived from Human Papillomavirus
CPPLELKNTVLEDGD

SEQ ID NO: 46919 - protein, 15 aa, Artificial Sequence
  Peptide Derived from Human Papillomavirus
DDYVTPTSIFYHAGS

SEQ ID NO: 46920 - protein, 15 aa, Artificial Sequence
  Peptide Derived from Human Papillomavirus
DLQFIFQLCTITLTA

SEQ ID NO: 46921 - protein, 15 aa, Artificial Sequence
  Peptide Derived from Human Papillomavirus
DNTVYLPPPSVARVV

SEQ ID NO: 46922 - protein, 15 aa, Artificial Sequence
  Peptide Derived from Human Papillomavirus
DTSIYNPETQRLVWA

SEQ ID NO: 46923 - protein, 15 aa, Artificial Sequence
  Peptide Derived from Human Papillomavirus
DWNFGVPPPPTTSLV

SEQ ID NO: 46924 - protein, 15 aa, Artificial Sequence
  Peptide Derived from Human Papillomavirus
EVPLDICQSICKYPD

SEQ ID NO: 46925 - protein, 15 aa, Artificial Sequence
  Peptide Derived from Human Papillomavirus
FFCLRREQLFARHFW

SEQ ID NO: 46926 - protein, 15 aa, Artificial Sequence
  Peptide Derived from Human Papillomavirus
FLQMALWRPSDNTVY

SEQ ID NO: 46927 - protein, 15 aa, Artificial Sequence
  Peptide Derived from Human Papillomavirus
FPIFLQMALWRPSDN

SEQ ID NO: 46928 - protein, 15 aa, Artificial Sequence
  Peptide Derived from Human Papillomavirus
FSTLQDTKCEVPLDI

SEQ ID NO: 46929 - protein, 15 aa, Artificial Sequence
  Peptide Derived from Human Papillomavirus
FVTVVDTTPSTNLTI

SEQ ID NO: 46930 - protein, 15 aa, Artificial Sequence
  Peptide Derived from Human Papillomavirus
GEHWAKGTACKSRPL

SEQ ID NO: 46931 - protein, 15 aa, Artificial Sequence
  Peptide Derived from Human Papillomavirus
GNPYFRVPAGGGNKQ

SEQ ID NO: 46932 - protein, 15 aa, Artificial Sequence
  Peptide Derived from Human Papillomavirus
GPLYHPRPLPLHSIL

SEQ ID NO: 46933 - protein, 15 aa, Artificial Sequence
  Peptide Derived from Human Papillomavirus
GQPLGVGLSGHPFYN

SEQ ID NO: 46934 - protein, 15 aa, Artificial Sequence
  Peptide Derived from Human Papillomavirus
GSCVYSPSPSGSIVT

SEQ ID NO: 46935 - protein, 15 aa, Artificial Sequence
  Peptide Derived from Human Papillomavirus
GVEIGRGQPLGVGLS

SEQ ID NO: 46936 - protein, 15 aa, Artificial Sequence
  Peptide Derived from Human Papillomavirus
HIIICGHYIILFLRN

SEQ ID NO: 46937 - protein, 15 aa, Artificial Sequence
  Peptide Derived from Human Papillomavirus
HNQLFVTVVDTTPST

SEQ ID NO: 46938 - protein, 15 aa, Artificial Sequence
  Peptide Derived from Human Papillomavirus
IFQLCTITLTADVMS

SEQ ID NO: 46939 - protein, 15 aa, Artificial Sequence
  Peptide Derived from Human Papillomavirus
IHSMNSSILEDWNFG

SEQ ID NO: 46940 - protein, 15 aa, Artificial Sequence
  Peptide Derived from Human Papillomavirus
ILFLRNVNVFPIFLQ

SEQ ID NO: 46941 - protein, 15 aa, Artificial Sequence
  Peptide Derived from Human Papillomavirus
ILHYHLLPLYGPLYH

SEQ ID NO: 46942 - protein, 15 aa, Artificial Sequence
  Peptide Derived from Human Papillomavirus
ILVYMVHIIICGHYI

SEQ ID NO: 46943 - protein, 15 aa, Artificial Sequence
  Peptide Derived from Human Papillomavirus
KCEVPLDICQSICKY

SEQ ID NO: 46944 - protein, 15 aa, Artificial Sequence
  Peptide Derived from Human Papillomavirus
KFGLPDTSIYNPETQ

SEQ ID NO: 46945 - protein, 15 aa, Artificial Sequence
  Peptide Derived from Human Papillomavirus
KLKFWNVDLKEKFSL

SEQ ID NO: 46946 - protein, 15 aa, Artificial Sequence
  Peptide Derived from Human Papillomavirus
KQDIPKVSAYQYRVF

SEQ ID NO: 46947 - protein, 15 aa, Artificial Sequence
  Peptide Derived from Human Papillomavirus
LCILGCAPAIGEHWA

SEQ ID NO: 46948 - protein, 15 aa, Artificial Sequence
  Peptide Derived from Human Papillomavirus
LEDWNFGVPPPPTTS

SEQ ID NO: 46949 - protein, 15 aa, Artificial Sequence
  Peptide Derived from Human Papillomavirus
LHSILVYMVHIIICG

SEQ ID NO: 46950 - protein, 15 aa, Artificial Sequence
  Peptide Derived from Human Papillomavirus
LQFIFQLCTITLTAD

SEQ ID NO: 46951 - protein, 15 aa, Artificial Sequence
  Peptide Derived from Human Papillomavirus
LRNVNVFPIFLQMAL

SEQ ID NO: 46952 - protein, 15 aa, Artificial Sequence
  Peptide Derived from Human Papillomavirus
LVYMVHIIICGHYII

SEQ ID NO: 46953 - protein, 15 aa, Artificial Sequence
  Peptide Derived from Human Papillomavirus
MCLYTRVLILHYHLL

SEQ ID NO: 46954 - protein, 15 aa, Artificial Sequence
  Peptide Derived from Human Papillomavirus
MSYIHSMNSSILEDW

SEQ ID NO: 46955 - protein, 15 aa, Artificial Sequence
  Peptide Derived from Human Papillomavirus
NFGVPPPPTTSLVDT

SEQ ID NO: 46956 - protein, 15 aa, Artificial Sequence
  Peptide Derived from Human Papillomavirus
NKPYWLHKAQGHNNG

SEQ ID NO: 46957 - protein, 15 aa, Artificial Sequence
  Peptide Derived from Human Papillomavirus
NTVLEDGDMVDTGYG

SEQ ID NO: 46958 - protein, 15 aa, Artificial Sequence
  Peptide Derived from Human Papillomavirus
NTVYLPPPSVARVVN

SEQ ID NO: 46959 - protein, 15 aa, Artificial Sequence
  Peptide Derived from Human Papillomavirus
NVDLKEKFSLDLDQY

SEQ ID NO: 46960 - protein, 15 aa, Artificial Sequence
  Peptide Derived from Human Papillomavirus
NVNVFPIFLQMALWR

SEQ ID NO: 46961 - protein, 15 aa, Artificial Sequence
  Peptide Derived from Human Papillomavirus
NVSVDYKQTQLCILG

SEQ ID NO: 46962 - protein, 15 aa, Artificial Sequence
  Peptide Derived from Human Papillomavirus
PLDICQSICKYPDYL

SEQ ID NO: 46963 - protein, 15 aa, Artificial Sequence
  Peptide Derived from Human Papillomavirus
PLELKNTVLEDGDMV

SEQ ID NO: 46964 - protein, 15 aa, Artificial Sequence
  Peptide Derived from Human Papillomavirus
PLPLHSILVYMVHII

SEQ ID NO: 46965 - protein, 15 aa, Artificial Sequence
  Peptide Derived from Human Papillomavirus
PNKFGLPDTSIYNPE

SEQ ID NO: 46966 - protein, 15 aa, Artificial Sequence
  Peptide Derived from Human Papillomavirus
PQSLYIKGTGMPASP

SEQ ID NO: 46967 - protein, 15 aa, Artificial Sequence
  Peptide Derived from Human Papillomavirus
PRPLPLHSILVYMVH

SEQ ID NO: 46968 - protein, 15 aa, Artificial Sequence
  Peptide Derived from Human Papillomavirus
QAGLRRKPTIGPRKR

SEQ ID NO: 46969 - protein, 15 aa, Artificial Sequence
  Peptide Derived from Human Papillomavirus
QFIFQLCTITLTADV

SEQ ID NO: 46970 - protein, 15 aa, Artificial Sequence
  Peptide Derived from Human Papillomavirus
QLCILGCAPAIGEHW

SEQ ID NO: 46971 - protein, 15 aa, Artificial Sequence
  Peptide Derived from Human Papillomavirus
QLFVTVVDTTPSTNL

SEQ ID NO: 46972 - protein, 15 aa, Artificial Sequence
  Peptide Derived from Human Papillomavirus
QTQLCILGCAPAIGE

SEQ ID NO: 46973 - protein, 15 aa, Artificial Sequence
  Peptide Derived from Human Papillomavirus
QYPLGRKFLVQAGLR

SEQ ID NO: 46974 - protein, 15 aa, Artificial Sequence
  Peptide Derived from Human Papillomavirus
QYRVFRVQLPDPNKF

SEQ ID NO: 46975 - protein, 15 aa, Artificial Sequence
  Peptide Derived from Human Papillomavirus
RHFWNRAGTMGDTVP

SEQ ID NO: 46976 - protein, 15 aa, Artificial Sequence
  Peptide Derived from Human Papillomavirus
RKFLVQAGLRRKPTI

SEQ ID NO: 46977 - protein, 15 aa, Artificial Sequence
  Peptide Derived from Human Papillomavirus
RLVWACAGVEIGRGQ

SEQ ID NO: 46978 - protein, 15 aa, Artificial Sequence
  Peptide Derived from Human Papillomavirus
RVLILHYHLLPLYGP

SEQ ID NO: 46979 - protein, 15 aa, Artificial Sequence
  Peptide Derived from Human Papillomavirus
SCVYSPSPSGSIVTS

SEQ ID NO: 46980 - protein, 15 aa, Artificial Sequence
  Peptide Derived from Human Papillomavirus
SEDVRDNVSVDYKQT

SEQ ID NO: 46981 - protein, 15 aa, Artificial Sequence
  Peptide Derived from Human Papillomavirus
SGSIVTSDSQLFNKP

SEQ ID NO: 46982 - protein, 15 aa, Artificial Sequence
  Peptide Derived from Human Papillomavirus
SIFYHAGSSRLLTVG

SEQ ID NO: 46983 - protein, 15 aa, Artificial Sequence
  Peptide Derived from Human Papillomavirus
SILVYMVHIIICGHY

SEQ ID NO: 46984 - protein, 15 aa, Artificial Sequence
  Peptide Derived from Human Papillomavirus
SLDLDQYPLGRKFLV

SEQ ID NO: 46985 - protein, 15 aa, Artificial Sequence
  Peptide Derived from Human Papillomavirus
SLYIKGTGMPASPGS

SEQ ID NO: 46986 - protein, 15 aa, Artificial Sequence
  Peptide Derived from Human Papillomavirus
SRHVEEYDLQFIFQL

SEQ ID NO: 46987 - protein, 15 aa, Artificial Sequence
  Peptide Derived from Human Papillomavirus
SRLLTVGNPYFRVPA

SEQ ID NO: 46988 - protein, 15 aa, Artificial Sequence
  Peptide Derived from Human Papillomavirus
SRPLSQGDCPPLELK

SEQ ID NO: 46989 - protein, 15 aa, Artificial Sequence
  Peptide Derived from Human Papillomavirus
STNLTICASTQSPVP

SEQ ID NO: 46990 - protein, 15 aa, Artificial Sequence
  Peptide Derived from Human Papillomavirus
SVDYKQTQLCILGCA

SEQ ID NO: 46991 - protein, 15 aa, Artificial Sequence
  Peptide Derived from Human Papillomavirus
TDDYVTPTSIFYHAG

SEQ ID NO: 46992 - protein, 15 aa, Artificial Sequence
  Peptide Derived from Human Papillomavirus
TITLTADVMSYIHSM

SEQ ID NO: 46993 - protein, 15 aa, Artificial Sequence
  Peptide Derived from Human Papillomavirus
TQRLVWACAGVEIGR

SEQ ID NO: 46994 - protein, 15 aa, Artificial Sequence
  Peptide Derived from Human Papillomavirus
TSIFYHAGSSRLLTV

SEQ ID NO: 46995 - protein, 15 aa, Artificial Sequence
  Peptide Derived from Human Papillomavirus
TVYLPPPSVARVVNT

SEQ ID NO: 46996 - protein, 15 aa, Artificial Sequence
  Peptide Derived from Human Papillomavirus
TYRFVQSVAITCQKD

SEQ ID NO: 46997 - protein, 15 aa, Artificial Sequence
  Peptide Derived from Human Papillomavirus
VDTYRFVQSVAITCQ

SEQ ID NO: 46998 - protein, 15 aa, Artificial Sequence
  Peptide Derived from Human Papillomavirus
VEEYDLQFIFQLCTI

SEQ ID NO: 46999 - protein, 15 aa, Artificial Sequence
  Peptide Derived from Human Papillomavirus
VFPIFLQMALWRPSD

SEQ ID NO: 47000 - protein, 15 aa, Artificial Sequence
  Peptide Derived from Human Papillomavirus
VFRVQLPDPNKFGLP

SEQ ID NO: 47001 - protein, 15 aa, Artificial Sequence
  Peptide Derived from Human Papillomavirus
VLILHYHLLPLYGPL

SEQ ID NO: 47002 - protein, 15 aa, Artificial Sequence
  Peptide Derived from Human Papillomavirus
VTVVDTTPSTNLTIC

SEQ ID NO: 47003 - protein, 15 aa, Artificial Sequence
  Peptide Derived from Human Papillomavirus
VYMVHIIICGHYIIL

SEQ ID NO: 47004 - protein, 15 aa, Artificial Sequence
  Peptide Derived from Human Papillomavirus
YDKLKFWNVDLKEKF

SEQ ID NO: 47005 - protein, 15 aa, Artificial Sequence
  Peptide Derived from Human Papillomavirus
YGAMDFSTLQDTKCE

SEQ ID NO: 47006 - protein, 15 aa, Artificial Sequence
  Peptide Derived from Human Papillomavirus
YGPLYHPRPLPLHSI

SEQ ID NO: 47007 - protein, 15 aa, Artificial Sequence
  Peptide Derived from Human Papillomavirus
YHLLPLYGPLYHPRP

SEQ ID NO: 47008 - protein, 15 aa, Artificial Sequence
  Peptide Derived from Human Papillomavirus
YIILFLRNVNVFPIF

SEQ ID NO: 47009 - protein, 15 aa, Artificial Sequence
  Peptide Derived from Human Papillomavirus
YNKLDDTESSHAATS

SEQ ID NO: 47010 - protein, 15 aa, Artificial Sequence
  Peptide Derived from Human Papillomavirus
YPDYLQMSADPYGDS

SEQ ID NO: 47011 - protein, 15 aa, Artificial Sequence
  Peptide Derived from Human Papillomavirus
YRFVQSVAITCQKDA

SEQ ID NO: 47012 - protein, 15 aa, Artificial Sequence
  Peptide Derived from Human Papillomavirus
YRVFRVQLPDPNKFG

SEQ ID NO: 47013 - protein, 15 aa, Artificial Sequence
  Peptide Derived from Human Papillomavirus
  VARIANT 1, 2, 3: Xaa= Any amino acid
XXXMVSHRAARRKRA

SEQ ID NO: 47014 - protein, 15 aa, Artificial Sequence
  Peptide Derived from Human Papillomavirus
  VARIANT 1, 2: Xaa= Any amino acid
XXMVSHRAARRKRAS

SEQ ID NO: 47015 - protein, 15 aa, Artificial Sequence
  Peptide Derived from Human Papillomavirus
ADDMDPAVPVPSRST

SEQ ID NO: 47016 - protein, 15 aa, Artificial Sequence
  Peptide Derived from Human Papillomavirus
ADKILQWSSLGIFLG

SEQ ID NO: 47017 - protein, 15 aa, Artificial Sequence
  Peptide Derived from Human Papillomavirus
AGNVFVGTPTSGTHG

SEQ ID NO: 47018 - protein, 15 aa, Artificial Sequence
  Peptide Derived from Human Papillomavirus
ASSYSNVTVPLTSSW

SEQ ID NO: 47019 - protein, 15 aa, Artificial Sequence
  Peptide Derived from Human Papillomavirus
ATMFTRSGTQIGARV

SEQ ID NO: 47020 - protein, 15 aa, Artificial Sequence
  Peptide Derived from Human Papillomavirus
AVPVPSRSTTSFAFF

SEQ ID NO: 47021 - protein, 15 aa, Artificial Sequence
  Peptide Derived from Human Papillomavirus
DITLPSTTSVWPIVS

SEQ ID NO: 47022 - protein, 15 aa, Artificial Sequence
  Peptide Derived from Human Papillomavirus
DKILQWSSLGIFLGG

SEQ ID NO: 47023 - protein, 15 aa, Artificial Sequence
  Peptide Derived from Human Papillomavirus
DNDLFDIYADDMDPA

SEQ ID NO: 47024 - protein, 15 aa, Artificial Sequence
  Peptide Derived from Human Papillomavirus
DSSVVTSGAPRPTFT

SEQ ID NO: 47025 - protein, 15 aa, Artificial Sequence
  Peptide Derived from Human Papillomavirus
EEPISSTPLPTVRRV

SEQ ID NO: 47026 - protein, 15 aa, Artificial Sequence
  Peptide Derived from Human Papillomavirus
EIPLQTFASSGTGEE

SEQ ID NO: 47027 - protein, 15 aa, Artificial Sequence
  Peptide Derived from Human Papillomavirus
FAFFKYSPTISSASS

SEQ ID NO: 47028 - protein, 15 aa, Artificial Sequence
  Peptide Derived from Human Papillomavirus
FEPVDTTLTFDPRSD

SEQ ID NO: 47029 - protein, 15 aa, Artificial Sequence
  Peptide Derived from Human Papillomavirus
FFKYSPTISSASSYS

SEQ ID NO: 47030 - protein, 15 aa, Artificial Sequence
  Peptide Derived from Human Papillomavirus
FSRLGQRATMFTRSG

SEQ ID NO: 47031 - protein, 15 aa, Artificial Sequence
  Peptide Derived from Human Papillomavirus
GFDITSAGTTTPAVL

SEQ ID NO: 47032 - protein, 15 aa, Artificial Sequence
  Peptide Derived from Human Papillomavirus
GIFLGGLGIGTGSGT

SEQ ID NO: 47033 - protein, 15 aa, Artificial Sequence
  Peptide Derived from Human Papillomavirus
GNVFVGTPTSGTHGY

SEQ ID NO: 47034 - protein, 15 aa, Artificial Sequence
  Peptide Derived from Human Papillomavirus
GPDITLPSTTSVWPI

SEQ ID NO: 47035 - protein, 15 aa, Artificial Sequence
  Peptide Derived from Human Papillomavirus
GTHYYLWPLYYFIPK

SEQ ID NO: 47036 - protein, 15 aa, Artificial Sequence
  Peptide Derived from Human Papillomavirus
GTTLADKILQWSSLG

SEQ ID NO: 47037 - protein, 15 aa, Artificial Sequence
  Peptide Derived from Human Papillomavirus
IEPVGPTDPSIVTLI

SEQ ID NO: 47038 - protein, 15 aa, Artificial Sequence
  Peptide Derived from Human Papillomavirus
IIRLHRPALTSRRGT

SEQ ID NO: 47039 - protein, 15 aa, Artificial Sequence
  Peptide Derived from Human Papillomavirus
ILQWSSLGIFLGGLG

SEQ ID NO: 47040 - protein, 15 aa, Artificial Sequence
  Peptide Derived from Human Papillomavirus
IVTLIEDSSVVTSGA

SEQ ID NO: 47041 - protein, 15 aa, Artificial Sequence
  Peptide Derived from Human Papillomavirus
LFDIYADDMDPAVPV

SEQ ID NO: 47042 - protein, 15 aa, Artificial Sequence
  Peptide Derived from Human Papillomavirus
LQTFASSGTGEEPIS

SEQ ID NO: 47043 - protein, 15 aa, Artificial Sequence
  Peptide Derived from Human Papillomavirus
LWPLYYFIPKKRKRV

SEQ ID NO: 47044 - protein, 15 aa, Artificial Sequence
  Peptide Derived from Human Papillomavirus
MDIIRLHRPALTSRR

SEQ ID NO: 47045 - protein, 15 aa, Artificial Sequence
  Peptide Derived from Human Papillomavirus
NPAFEPVDTTLTFDP

SEQ ID NO: 47046 - protein, 15 aa, Artificial Sequence
  Peptide Derived from Human Papillomavirus
NPAFSDPSIIEVPQT

SEQ ID NO: 47047 - protein, 15 aa, Artificial Sequence
  Peptide Derived from Human Papillomavirus
NPEFLTRPSSLITYD

SEQ ID NO: 47048 - protein, 15 aa, Artificial Sequence
  Peptide Derived from Human Papillomavirus
NTVVDVGPTRPPVVI

SEQ ID NO: 47049 - protein, 15 aa, Artificial Sequence
  Peptide Derived from Human Papillomavirus
NVFVGTPTSGTHGYE

SEQ ID NO: 47050 - protein, 15 aa, Artificial Sequence
  Peptide Derived from Human Papillomavirus
NVTVPLTSSWDVPVY

SEQ ID NO: 47051 - protein, 15 aa, Artificial Sequence
  Peptide Derived from Human Papillomavirus
PAVLDITPSSTSVSI

SEQ ID NO: 47052 - protein, 15 aa, Artificial Sequence
  Peptide Derived from Human Papillomavirus
PEFLTRPSSLITYDN

SEQ ID NO: 47053 - protein, 15 aa, Artificial Sequence
  Peptide Derived from Human Papillomavirus
PEYIELQPLVSATED

SEQ ID NO: 47054 - protein, 15 aa, Artificial Sequence
  Peptide Derived from Human Papillomavirus
PSIIEVPQTGEVAGN

SEQ ID NO: 47055 - protein, 15 aa, Artificial Sequence
  Peptide Derived from Human Papillomavirus
PVVIEPVGPTDPSIV

SEQ ID NO: 47056 - protein, 15 aa, Artificial Sequence
  Peptide Derived from Human Papillomavirus
RGTVRFSRLGQRATM

SEQ ID NO: 47057 - protein, 15 aa, Artificial Sequence
  Peptide Derived from Human Papillomavirus
RKRVPYFFADGFVAA

SEQ ID NO: 47058 - protein, 15 aa, Artificial Sequence
  Peptide Derived from Human Papillomavirus
RPPVVIEPVGPTDPS

SEQ ID NO: 47059 - protein, 15 aa, Artificial Sequence
  Peptide Derived from Human Papillomavirus
RVHFYHDISPIAPSP

SEQ ID NO: 47060 - protein, 15 aa, Artificial Sequence
  Peptide Derived from Human Papillomavirus
SDFMDIIRLHRPALT

SEQ ID NO: 47061 - protein, 15 aa, Artificial Sequence
  Peptide Derived from Human Papillomavirus
SFAFFKYSPTISSAS

SEQ ID NO: 47062 - protein, 15 aa, Artificial Sequence
  Peptide Derived from Human Papillomavirus
SLGIFLGGLGIGTGS

SEQ ID NO: 47063 - protein, 15 aa, Artificial Sequence
  Peptide Derived from Human Papillomavirus
SNTVVDVGPTRPPVV

SEQ ID NO: 47064 - protein, 15 aa, Artificial Sequence
  Peptide Derived from Human Papillomavirus
SPEYIELQPLVSATE

SEQ ID NO: 47065 - protein, 15 aa, Artificial Sequence
  Peptide Derived from Human Papillomavirus
SPTISSASSYSNVTV

SEQ ID NO: 47066 - protein, 15 aa, Artificial Sequence
  Peptide Derived from Human Papillomavirus
SRAYQQVSVANPEFL

SEQ ID NO: 47067 - protein, 15 aa, Artificial Sequence
  Peptide Derived from Human Papillomavirus
SSLITYDNPAFEPVD

SEQ ID NO: 47068 - protein, 15 aa, Artificial Sequence
  Peptide Derived from Human Papillomavirus
SSVVTSGAPRPTFTG

SEQ ID NO: 47069 - protein, 15 aa, Artificial Sequence
  Peptide Derived from Human Papillomavirus
STSVSISTTNFTNPA

SEQ ID NO: 47070 - protein, 15 aa, Artificial Sequence
  Peptide Derived from Human Papillomavirus
THGYEEIPLQTFASS

SEQ ID NO: 47071 - protein, 15 aa, Artificial Sequence
  Peptide Derived from Human Papillomavirus
TPAVLDITPSSTSVS

SEQ ID NO: 47072 - protein, 15 aa, Artificial Sequence
  Peptide Derived from Human Papillomavirus
TQYIGIHGTHYYLWP

SEQ ID NO: 47073 - protein, 15 aa, Artificial Sequence
  Peptide Derived from Human Papillomavirus
TSGFDITSAGTTTPA

SEQ ID NO: 47074 - protein, 15 aa, Artificial Sequence
  Peptide Derived from Human Papillomavirus
TSVWPIVSPTAPAST

SEQ ID NO: 47075 - protein, 15 aa, Artificial Sequence
  Peptide Derived from Human Papillomavirus
TTSVWPIVSPTAPAS

SEQ ID NO: 47076 - protein, 15 aa, Artificial Sequence
  Peptide Derived from Human Papillomavirus
VHFYHDISPIAPSPE

SEQ ID NO: 47077 - protein, 15 aa, Artificial Sequence
  Peptide Derived from Human Papillomavirus
VLDITPSSTSVSIST

SEQ ID NO: 47078 - protein, 15 aa, Artificial Sequence
  Peptide Derived from Human Papillomavirus
VPKVEGTTLADKILQ

SEQ ID NO: 47079 - protein, 15 aa, Artificial Sequence
  Peptide Derived from Human Papillomavirus
VPVYTGPDITLPSTT

SEQ ID NO: 47080 - protein, 15 aa, Artificial Sequence
  Peptide Derived from Human Papillomavirus
VRRVAGPRLYSRAYQ

SEQ ID NO: 47081 - protein, 15 aa, Artificial Sequence
  Peptide Derived from Human Papillomavirus
VTLIEDSSVVTSGAP

SEQ ID NO: 47082 - protein, 15 aa, Artificial Sequence
  Peptide Derived from Human Papillomavirus
VVDVGPTRPPVVIEP

SEQ ID NO: 47083 - protein, 15 aa, Artificial Sequence
  Peptide Derived from Human Papillomavirus
VWPIVSPTAPASTQY

SEQ ID NO: 47084 - protein, 15 aa, Artificial Sequence
  Peptide Derived from Human Papillomavirus
WPIVSPTAPASTQYI

SEQ ID NO: 47085 - protein, 15 aa, Artificial Sequence
  Peptide Derived from Human Papillomavirus
YHDISPIAPSPEYIE

SEQ ID NO: 47086 - protein, 15 aa, Artificial Sequence
  Peptide Derived from Human Papillomavirus
YIELQPLVSATEDND

SEQ ID NO: 47087 - protein, 15 aa, Artificial Sequence
  Peptide Derived from Human Papillomavirus
YQQVSVANPEFLTRP

SEQ ID NO: 47088 - protein, 15 aa, Artificial Sequence
  Peptide Derived from Human Papillomavirus
YSNVTVPLTSSWDVP

SEQ ID NO: 47089 - protein, 15 aa, Artificial Sequence
  Peptide Derived from Human Papillomavirus
AAALYWYRTGMSNIS

SEQ ID NO: 47090 - protein, 15 aa, Artificial Sequence
  Peptide Derived from Human Papillomavirus
ACAFLKSNSQAKIVK

SEQ ID NO: 47091 - protein, 15 aa, Artificial Sequence
  Peptide Derived from Human Papillomavirus
ACSWGMVMLMLVRFK

SEQ ID NO: 47092 - protein, 15 aa, Artificial Sequence
  Peptide Derived from Human Papillomavirus
AFGVTGTVAEGFKTL

SEQ ID NO: 47093 - protein, 15 aa, Artificial Sequence
  Peptide Derived from Human Papillomavirus
AKIVKDCGTMCRHYK

SEQ ID NO: 47094 - protein, 15 aa, Artificial Sequence
  Peptide Derived from Human Papillomavirus
ALKLFLKGVPKKNCI

SEQ ID NO: 47095 - protein, 15 aa, Artificial Sequence
  Peptide Derived from Human Papillomavirus
ALYWYRTGMSNISDV

SEQ ID NO: 47096 - protein, 15 aa, Artificial Sequence
  Peptide Derived from Human Papillomavirus
CMLIQPPKLRSTAAA

SEQ ID NO: 47097 - protein, 15 aa, Artificial Sequence
  Peptide Derived from Human Papillomavirus
CNGWFYVEAVIDRQT

SEQ ID NO: 47098 - protein, 15 aa, Artificial Sequence
  Peptide Derived from Human Papillomavirus
CWHYIDNYLRNALDG

SEQ ID NO: 47099 - protein, 15 aa, Artificial Sequence
  Peptide Derived from Human Papillomavirus
DDRWPYLHSRLVVFT

SEQ ID NO: 47100 - protein, 15 aa, Artificial Sequence
  Peptide Derived from Human Papillomavirus
DKNWKSFFSRTWCRL

SEQ ID NO: 47101 - protein, 15 aa, Artificial Sequence
  Peptide Derived from Human Papillomavirus
DSEIAYKYAQLADSD

SEQ ID NO: 47102 - protein, 15 aa, Artificial Sequence
  Peptide Derived from Human Papillomavirus
DSGYGNTEVETQQMV

SEQ ID NO: 47103 - protein, 15 aa, Artificial Sequence
  Peptide Derived from Human Papillomavirus
DTTFDLSQMVQWAYD

SEQ ID NO: 47104 - protein, 15 aa, Artificial Sequence
  Peptide Derived from Human Papillomavirus
DWCVAAFGVTGTVAE

SEQ ID NO: 47105 - protein, 15 aa, Artificial Sequence
  Peptide Derived from Human Papillomavirus
EIAYKYAQLADSDSN

SEQ ID NO: 47106 - protein, 15 aa, Artificial Sequence
  Peptide Derived from Human Papillomavirus
EKLLEKLLCISTNCM

SEQ ID NO: 47107 - protein, 12 aa, Artificial Sequence
  Peptide Derived from Human Papillomavirus
FKCVSGQNIRTL

SEQ ID NO: 47108 - protein, 15 aa, Artificial Sequence
  Peptide Derived from Human Papillomavirus
FKTLLQPYCLYCHLQ

SEQ ID NO: 47109 - protein, 15 aa, Artificial Sequence
  Peptide Derived from Human Papillomavirus
GCIISYANSKSHFWL

SEQ ID NO: 47110 - protein, 15 aa, Artificial Sequence
  Peptide Derived from Human Papillomavirus
GDSFSTFKCVSGQNI

SEQ ID NO: 47111 - protein, 15 aa, Artificial Sequence
  Peptide Derived from Human Papillomavirus
GKSYFGMSLISFLQG

SEQ ID NO: 47112 - protein, 15 aa, Artificial Sequence
  Peptide Derived from Human Papillomavirus
GSPLSDISSCVDYNI

SEQ ID NO: 47113 - protein, 15 aa, Artificial Sequence
  Peptide Derived from Human Papillomavirus
GWFYVEAVIDRQTGD

SEQ ID NO: 47114 - protein, 15 aa, Artificial Sequence
  Peptide Derived from Human Papillomavirus
HKALMQLKCPPLLIT

SEQ ID NO: 47115 - protein, 15 aa, Artificial Sequence
  Peptide Derived from Human Papillomavirus
IDNYLRNALDGNPVS

SEQ ID NO: 47116 - protein, 15 aa, Artificial Sequence
  Peptide Derived from Human Papillomavirus
IEFVSFLSALKLFLK

SEQ ID NO: 47117 - protein, 15 aa, Artificial Sequence
  Peptide Derived from Human Papillomavirus
IEKLLEKLLCISTNC

SEQ ID NO: 47118 - protein, 15 aa, Artificial Sequence
  Peptide Derived from Human Papillomavirus
IGMLDDATTPCWHYI

SEQ ID NO: 47119 - protein, 15 aa, Artificial Sequence
  Peptide Derived from Human Papillomavirus
IISYANSKSHFWLQP

SEQ ID NO: 47120 - protein, 15 aa, Artificial Sequence
  Peptide Derived from Human Papillomavirus
IRPFQSNKSTCTDWC

SEQ ID NO: 47121 - protein, 15 aa, Artificial Sequence
  Peptide Derived from Human Papillomavirus
ISDVYGETPEWIERQ

SEQ ID NO: 47122 - protein, 15 aa, Artificial Sequence
  Peptide Derived from Human Papillomavirus
ISFLQGCIISYANSK

SEQ ID NO: 47123 - protein, 15 aa, Artificial Sequence
  Peptide Derived from Human Papillomavirus
KALMQLKCPPLLITS

SEQ ID NO: 47124 - protein, 15 aa, Artificial Sequence
  Peptide Derived from Human Papillomavirus
KELYGVSFMELIRPF

SEQ ID NO: 47125 - protein, 15 aa, Artificial Sequence
  Peptide Derived from Human Papillomavirus
KIGMLDDATTPCWHY

SEQ ID NO: 47126 - protein, 15 aa, Artificial Sequence
  Peptide Derived from Human Papillomavirus
KNCILIHGAPNTGKS

SEQ ID NO: 47127 - protein, 15 aa, Artificial Sequence
  Peptide Derived from Human Papillomavirus
KNRITIEKLLEKLLC

SEQ ID NO: 47128 - protein, 15 aa, Artificial Sequence
  Peptide Derived from Human Papillomavirus
KRKYVGSPLSDISSC

SEQ ID NO: 47129 - protein, 15 aa, Artificial Sequence
  Peptide Derived from Human Papillomavirus
KSFFSRTWCRLNLHE

SEQ ID NO: 47130 - protein, 15 aa, Artificial Sequence
  Peptide Derived from Human Papillomavirus
KSHFWLQPLADAKIG

SEQ ID NO: 47131 - protein, 15 aa, Artificial Sequence
  Peptide Derived from Human Papillomavirus
KSYFGMSLISFLQGC

SEQ ID NO: 47132 - protein, 15 aa, Artificial Sequence
  Peptide Derived from Human Papillomavirus
KTLLQPYCLYCHLQS

SEQ ID NO: 47133 - protein, 15 aa, Artificial Sequence
  Peptide Derived from Human Papillomavirus
LEKLLCISTNCMLIQ

SEQ ID NO: 47134 - protein, 15 aa, Artificial Sequence
  Peptide Derived from Human Papillomavirus
LISFLQGCIISYANS

SEQ ID NO: 47135 - protein, 15 aa, Artificial Sequence
  Peptide Derived from Human Papillomavirus
LKGVPKKNCILIHGA

SEQ ID NO: 47136 - protein, 15 aa, Artificial Sequence
  Peptide Derived from Human Papillomavirus
LKLFLKGVPKKNCIL

SEQ ID NO: 47137 - protein, 15 aa, Artificial Sequence
  Peptide Derived from Human Papillomavirus
LLCISTNCMLIQPPK

SEQ ID NO: 47138 - protein, 15 aa, Artificial Sequence
  Peptide Derived from Human Papillomavirus
LMLVRFKCAKNRITI

SEQ ID NO: 47139 - protein, 15 aa, Artificial Sequence
  Peptide Derived from Human Papillomavirus
LMQLKCPPLLITSNI

SEQ ID NO: 47140 - protein, 15 aa, Artificial Sequence
  Peptide Derived from Human Papillomavirus
LQPLADAKIGMLDDA

SEQ ID NO: 47141 - protein, 15 aa, Artificial Sequence
  Peptide Derived from Human Papillomavirus
LVVFTFPNPFPFDKN

SEQ ID NO: 47142 - protein, 15 aa, Artificial Sequence
  Peptide Derived from Human Papillomavirus
LYGVSFMELIRPFQS

SEQ ID NO: 47143 - protein, 15 aa, Artificial Sequence
  Peptide Derived from Human Papillomavirus
LYWYRTGMSNISDVY

SEQ ID NO: 47144 - protein, 15 aa, Artificial Sequence
  Peptide Derived from Human Papillomavirus
MELIRPFQSNKSTCT

SEQ ID NO: 47145 - protein, 15 aa, Artificial Sequence
  Peptide Derived from Human Papillomavirus
MGQWIKSRCDKVSDE

SEQ ID NO: 47146 - protein, 15 aa, Artificial Sequence
  Peptide Derived from Human Papillomavirus
MLMLVRFKCAKNRIT

SEQ ID NO: 47147 - protein, 15 aa, Artificial Sequence
  Peptide Derived from Human Papillomavirus
MVQVEEQQTTLSCNG

SEQ ID NO: 47148 - protein, 15 aa, Artificial Sequence
  Peptide Derived from Human Papillomavirus
NCILIHGAPNTGKSY

SEQ ID NO: 47149 - protein, 15 aa, Artificial Sequence
  Peptide Derived from Human Papillomavirus
NCNVYNNQAEAETAQ

SEQ ID NO: 47150 - protein, 15 aa, Artificial Sequence
  Peptide Derived from Human Papillomavirus
NDVMDDSEIAYKYAQ

SEQ ID NO: 47151 - protein, 15 aa, Artificial Sequence
  Peptide Derived from Human Papillomavirus
NGWFYVEAVIDRQTG

SEQ ID NO: 47152 - protein, 15 aa, Artificial Sequence
  Peptide Derived from Human Papillomavirus
NTEVETQQMVQVEEQ

SEQ ID NO: 47153 - protein, 15 aa, Artificial Sequence
  Peptide Derived from Human Papillomavirus
PEWIERQTVLQHSFN

SEQ ID NO: 47154 - protein, 15 aa, Artificial Sequence
  Peptide Derived from Human Papillomavirus
PPKLRSTAAALYWYR

SEQ ID NO: 47155 - protein, 15 aa, Artificial Sequence
  Peptide Derived from Human Papillomavirus
PPLLITSNINAGKDD

SEQ ID NO: 47156 - protein, 15 aa, Artificial Sequence
  Peptide Derived from Human Papillomavirus
QALFHAQEAEEHAEA

SEQ ID NO: 47157 - protein, 15 aa, Artificial Sequence
  Peptide Derived from Human Papillomavirus
QIEFVSFLSALKLFL

SEQ ID NO: 47158 - protein, 15 aa, Artificial Sequence
  Peptide Derived from Human Papillomavirus
QTTLSCNGSDGTHSE

SEQ ID NO: 47159 - protein, 15 aa, Artificial Sequence
  Peptide Derived from Human Papillomavirus
QWAYDNDVMDDSEIA

SEQ ID NO: 47160 - protein, 15 aa, Artificial Sequence
  Peptide Derived from Human Papillomavirus
RKYVGSPLSDISSCV

SEQ ID NO: 47161 - protein, 15 aa, Artificial Sequence
  Peptide Derived from Human Papillomavirus
RNALDGNPVSIDVKH

SEQ ID NO: 47162 - protein, 15 aa, Artificial Sequence
  Peptide Derived from Human Papillomavirus
RNILQVLKTSNGKAA

SEQ ID NO: 47163 - protein, 15 aa, Artificial Sequence
  Peptide Derived from Human Papillomavirus
RRLFELPDSGYGNTE

SEQ ID NO: 47164 - protein, 15 aa, Artificial Sequence
  Peptide Derived from Human Papillomavirus
RWPYLHSRLVVFTFP

SEQ ID NO: 47165 - protein, 15 aa, Artificial Sequence
  Peptide Derived from Human Papillomavirus
SHFWLQPLADAKIGM

SEQ ID NO: 47166 - protein, 15 aa, Artificial Sequence
  Peptide Derived from Human Papillomavirus
SIDVKHKALMQLKCP

SEQ ID NO: 47167 - protein, 15 aa, Artificial Sequence
  Peptide Derived from Human Papillomavirus
SPRLKAICIENNSKT

SEQ ID NO: 47168 - protein, 15 aa, Artificial Sequence
  Peptide Derived from Human Papillomavirus
SRLVVFTFPNPFPFD

SEQ ID NO: 47169 - protein, 15 aa, Artificial Sequence
  Peptide Derived from Human Papillomavirus
SRTWCRLNLHEEEDK

SEQ ID NO: 47170 - protein, 15 aa, Artificial Sequence
  Peptide Derived from Human Papillomavirus
SSCVDYNISPRLKAI

SEQ ID NO: 47171 - protein, 15 aa, Artificial Sequence
  Peptide Derived from Human Papillomavirus
SWGMVMLMLVRFKCA

SEQ ID NO: 47172 - protein, 15 aa, Artificial Sequence
  Peptide Derived from Human Papillomavirus
TNCMLIQPPKLRSTA

SEQ ID NO: 47173 - protein, 15 aa, Artificial Sequence
  Peptide Derived from Human Papillomavirus
TPEWIERQTVLQHSF

SEQ ID NO: 47174 - protein, 15 aa, Artificial Sequence
  Peptide Derived from Human Papillomavirus
VAAFGVTGTVAEGFK

SEQ ID NO: 47175 - protein, 15 aa, Artificial Sequence
  Peptide Derived from Human Papillomavirus
VDFIDNCNVYNNQAE

SEQ ID NO: 47176 - protein, 15 aa, Artificial Sequence
  Peptide Derived from Human Papillomavirus
VEAVIDRQTGDNISE

SEQ ID NO: 47177 - protein, 15 aa, Artificial Sequence
  Peptide Derived from Human Papillomavirus
VFTFPNPFPFDKNGN

SEQ ID NO: 47178 - protein, 15 aa, Artificial Sequence
  Peptide Derived from Human Papillomavirus
VKFLRYQQIEFVSFL

SEQ ID NO: 47179 - protein, 15 aa, Artificial Sequence
  Peptide Derived from Human Papillomavirus
VQVLKRKYVGSPLSD

SEQ ID NO: 47180 - protein, 15 aa, Artificial Sequence
  Peptide Derived from Human Papillomavirus
VSFLSALKLFLKGVP

SEQ ID NO: 47181 - protein, 15 aa, Artificial Sequence
  Peptide Derived from Human Papillomavirus
VSFMELIRPFQSNKS

SEQ ID NO: 47182 - protein, 15 aa, Artificial Sequence
  Peptide Derived from Human Papillomavirus
WGMVMLMLVRFKCAK

SEQ ID NO: 47183 - protein, 15 aa, Artificial Sequence
  Peptide Derived from Human Papillomavirus
WPYLHSRLVVFTFPN

SEQ ID NO: 47184 - protein, 15 aa, Artificial Sequence
  Peptide Derived from Human Papillomavirus
YAQLADSDSNACAFL

SEQ ID NO: 47185 - protein, 15 aa, Artificial Sequence
  Peptide Derived from Human Papillomavirus
YCHLQSLACSWGMVM

SEQ ID NO: 47186 - protein, 15 aa, Artificial Sequence
  Peptide Derived from Human Papillomavirus
YCLYCHLQSLACSWG

SEQ ID NO: 47187 - protein, 15 aa, Artificial Sequence
  Peptide Derived from Human Papillomavirus
AGIVTKLPTANNTTT

SEQ ID NO: 47188 - protein, 15 aa, Artificial Sequence
  Peptide Derived from Human Papillomavirus
AKALQAIELQMMLET

SEQ ID NO: 47189 - protein, 15 aa, Artificial Sequence
  Peptide Derived from Human Papillomavirus
ALSVSKAKALQAIEL

SEQ ID NO: 47190 - protein, 15 aa, Artificial Sequence
  Peptide Derived from Human Papillomavirus
AREMGIHSINHQVVP

SEQ ID NO: 47191 - protein, 15 aa, Artificial Sequence
  Peptide Derived from Human Papillomavirus
CGVISAAACTNQTRA

SEQ ID NO: 47192 - protein, 15 aa, Artificial Sequence
  Peptide Derived from Human Papillomavirus
DDFLNTVKIPNTVSV

SEQ ID NO: 47193 - protein, 15 aa, Artificial Sequence
  Peptide Derived from Human Papillomavirus
DWTMQQTSLELYLTA

SEQ ID NO: 47194 - protein, 15 aa, Artificial Sequence
  Peptide Derived from Human Papillomavirus
EGQVNCKGIYYVHEG

SEQ ID NO: 47195 - protein, 15 aa, Artificial Sequence
  Peptide Derived from Human Papillomavirus
EISFAGIVTKLPTAN

SEQ ID NO: 47196 - protein, 15 aa, Artificial Sequence
  Peptide Derived from Human Papillomavirus
ELQMMLETLNNTEYK

SEQ ID NO: 47197 - protein, 15 aa, Artificial Sequence
  Peptide Derived from Human Papillomavirus
ESVFSSDEISFAGIV

SEQ ID NO: 47198 - protein, 15 aa, Artificial Sequence
  Peptide Derived from Human Papillomavirus
FAGIVTKLPTANNTT

SEQ ID NO: 47199 - protein, 15 aa, Artificial Sequence
  Peptide Derived from Human Papillomavirus
GDSVDSVNCGVISAA

SEQ ID NO: 47200 - protein, 15 aa, Artificial Sequence
  Peptide Derived from Human Papillomavirus
GQVIVFPESVFSSDE

SEQ ID NO: 47201 - protein, 15 aa, Artificial Sequence
  Peptide Derived from Human Papillomavirus
HIRLECVLMYKAREM

SEQ ID NO: 47202 - protein, 15 aa, Artificial Sequence
  Peptide Derived from Human Papillomavirus
HITYFVNFTEEAKKY

SEQ ID NO: 47203 - protein, 15 aa, Artificial Sequence
  Peptide Derived from Human Papillomavirus
HQVVPALSVSKAKAL

SEQ ID NO: 47204 - protein, 15 aa, Artificial Sequence
  Peptide Derived from Human Papillomavirus
IDYWKHIRLECVLMY

SEQ ID NO: 47205 - protein, 15 aa, Artificial Sequence
  Peptide Derived from Human Papillomavirus
IHSINHQVVPALSVS

SEQ ID NO: 47206 - protein, 15 aa, Artificial Sequence
  Peptide Derived from Human Papillomavirus
IVTLTYISTSQRDDF

SEQ ID NO: 47207 - protein, 15 aa, Artificial Sequence
  Peptide Derived from Human Papillomavirus
IYYVHEGHITYFVNF

SEQ ID NO: 47208 - protein, 15 aa, Artificial Sequence
  Peptide Derived from Human Papillomavirus
KQLYEQVSSTWHWTC

SEQ ID NO: 47209 - protein, 15 aa, Artificial Sequence
  Peptide Derived from Human Papillomavirus
LECVLMYKAREMGIH

SEQ ID NO: 47210 - protein, 15 aa, Artificial Sequence
  Peptide Derived from Human Papillomavirus
LELYLTAPTGCLKKH

SEQ ID NO: 47211 - protein, 15 aa, Artificial Sequence
  Peptide Derived from Human Papillomavirus
LKCLRYRLSKYKQLY

SEQ ID NO: 47212 - protein, 15 aa, Artificial Sequence
  Peptide Derived from Human Papillomavirus
LNTVKIPNTVSVSTG

SEQ ID NO: 47213 - protein, 15 aa, Artificial Sequence
  Peptide Derived from Human Papillomavirus
LQAIELQMMLETLNN

SEQ ID NO: 47214 - protein, 15 aa, Artificial Sequence
  Peptide Derived from Human Papillomavirus
NAIVTLTYISTSQRD

SEQ ID NO: 47215 - protein, 15 aa, Artificial Sequence
  Peptide Derived from Human Papillomavirus
NCGVISAAACTNQTR

SEQ ID NO: 47216 - protein, 15 aa, Artificial Sequence
  Peptide Derived from Human Papillomavirus
NEDWTMQQTSLELYL

SEQ ID NO: 47217 - protein, 15 aa, Artificial Sequence
  Peptide Derived from Human Papillomavirus
NHQVVPALSVSKAKA

SEQ ID NO: 47218 - protein, 15 aa, Artificial Sequence
  Peptide Derived from Human Papillomavirus
NKLLRGDSVDSVNCG

SEQ ID NO: 47219 - protein, 15 aa, Artificial Sequence
  Peptide Derived from Human Papillomavirus
NWKFIYLCIDGQCTV

SEQ ID NO: 47220 - protein, 15 aa, Artificial Sequence
  Peptide Derived from Human Papillomavirus
PNKLLRGDSVDSVNC

SEQ ID NO: 47221 - protein, 15 aa, Artificial Sequence
  Peptide Derived from Human Papillomavirus
QCTVVEGQVNCKGIY

SEQ ID NO: 47222 - protein, 15 aa, Artificial Sequence
  Peptide Derived from Human Papillomavirus
QTSLELYLTAPTGCL

SEQ ID NO: 47223 - protein, 15 aa, Artificial Sequence
  Peptide Derived from Human Papillomavirus
QVIVFPESVFSSDEI

SEQ ID NO: 47224 - protein, 15 aa, Artificial Sequence
  Peptide Derived from Human Papillomavirus
RLNVCQDKILEHYEN

SEQ ID NO: 47225 - protein, 15 aa, Artificial Sequence
  Peptide Derived from Human Papillomavirus
SDEISFAGIVTKLPT

SEQ ID NO: 47226 - protein, 15 aa, Artificial Sequence
  Peptide Derived from Human Papillomavirus
SEGVRRATTSTKRPR

SEQ ID NO: 47227 - protein, 15 aa, Artificial Sequence
  Peptide Derived from Human Papillomavirus
SLELYLTAPTGCLKK

SEQ ID NO: 47228 - protein, 15 aa, Artificial Sequence
  Peptide Derived from Human Papillomavirus
SSTWHWTCTDGKHKN

SEQ ID NO: 47229 - protein, 15 aa, Artificial Sequence
  Peptide Derived from Human Papillomavirus
TRAVSCPATTPIIHL

SEQ ID NO: 47230 - protein, 15 aa, Artificial Sequence
  Peptide Derived from Human Papillomavirus
TVKIPNTVSVSTGYM

SEQ ID NO: 47231 - protein, 15 aa, Artificial Sequence
  Peptide Derived from Human Papillomavirus
VDSVNCGVISAAACT

SEQ ID NO: 47232 - protein, 15 aa, Artificial Sequence
  Peptide Derived from Human Papillomavirus
VLMYKAREMGIHSIN

SEQ ID NO: 47233 - protein, 15 aa, Artificial Sequence
  Peptide Derived from Human Papillomavirus
VPALSVSKAKALQAI

SEQ ID NO: 47234 - protein, 15 aa, Artificial Sequence
  Peptide Derived from Human Papillomavirus
WKHIRLECVLMYKAR

SEQ ID NO: 47235 - protein, 15 aa, Artificial Sequence
  Peptide Derived from Human Papillomavirus
YKQLYEQVSSTWHWT

SEQ ID NO: 47236 - protein, 15 aa, Artificial Sequence
  Peptide Derived from Human Papillomavirus
YLCIDGQCTVVEGQV

SEQ ID NO: 47237 - protein, 15 aa, Artificial Sequence
  Peptide Derived from Human Papillomavirus
YTNWKFIYLCIDGQC

SEQ ID NO: 47238 - protein, 15 aa, Artificial Sequence
  Peptide Derived from Human Papillomavirus
  VARIANT 1, 2, 3: Xaa= Any amino acid
XXXMIELNISTVSIV

SEQ ID NO: 47239 - protein, 15 aa, Artificial Sequence
  Peptide Derived from Human Papillomavirus
  VARIANT 1, 2: Xaa= Any amino acid
XXMIELNISTVSIVL

SEQ ID NO: 47240 - protein, 15 aa, Artificial Sequence
  Peptide Derived from Human Papillomavirus
ATLLLLIVILWVIAT

SEQ ID NO: 47241 - protein, 15 aa, Artificial Sequence
  Peptide Derived from Human Papillomavirus
CFCIYVVFIYIPLFV

SEQ ID NO: 47242 - protein, 15 aa, Artificial Sequence
  Peptide Derived from Human Papillomavirus
CFCVLLFVCLVIRPL

SEQ ID NO: 47243 - protein, 15 aa, Artificial Sequence
  Peptide Derived from Human Papillomavirus
CFLLCFCVLLFVCLV

SEQ ID NO: 47244 - protein, 15 aa, Artificial Sequence
  Peptide Derived from Human Papillomavirus
CIYVVFIYIPLFVIH

SEQ ID NO: 47245 - protein, 15 aa, Artificial Sequence
  Peptide Derived from Human Papillomavirus
CLVIRPLVLSVSVYA

SEQ ID NO: 47246 - protein, 15 aa, Artificial Sequence
  Peptide Derived from Human Papillomavirus
CVLLFVCLVIRPLVL

SEQ ID NO: 47247 - protein, 15 aa, Artificial Sequence
  Peptide Derived from Human Papillomavirus
ELNISTVSIVLCFLL

SEQ ID NO: 47248 - protein, 15 aa, Artificial Sequence
  Peptide Derived from Human Papillomavirus
FCVLLFVCLVIRPLV

SEQ ID NO: 47249 - protein, 15 aa, Artificial Sequence
  Peptide Derived from Human Papillomavirus
FIYIPLFVIHTHASF

SEQ ID NO: 47250 - protein, 15 aa, Artificial Sequence
  Peptide Derived from Human Papillomavirus
FVCLVIRPLVLSVSV

SEQ ID NO: 47251 - protein, 15 aa, Artificial Sequence
  Peptide Derived from Human Papillomavirus
ILWVIATSPLRCFCI

SEQ ID NO: 47252 - protein, 15 aa, Artificial Sequence
  Peptide Derived from Human Papillomavirus
IRPLVLSVSVYATLL

SEQ ID NO: 47253 - protein, 15 aa, Artificial Sequence
  Peptide Derived from Human Papillomavirus
ISTVSIVLCFLLCFC

SEQ ID NO: 47254 - protein, 15 aa, Artificial Sequence
  Peptide Derived from Human Papillomavirus
IVILWVIATSPLRCF

SEQ ID NO: 47255 - protein, 15 aa, Artificial Sequence
  Peptide Derived from Human Papillomavirus
IYVVFIYIPLFVIHT

SEQ ID NO: 47256 - protein, 15 aa, Artificial Sequence
  Peptide Derived from Human Papillomavirus
LCFLLCFCVLLFVCL

SEQ ID NO: 47257 - protein, 14 aa, Artificial Sequence
  Peptide Derived from Human Papillomavirus
LFVIHTHASFLSQQ

SEQ ID NO: 47258 - protein, 15 aa, Artificial Sequence
  Peptide Derived from Human Papillomavirus
LIVILWVIATSPLRC

SEQ ID NO: 47259 - protein, 15 aa, Artificial Sequence
  Peptide Derived from Human Papillomavirus
LLIVILWVIATSPLR

SEQ ID NO: 47260 - protein, 15 aa, Artificial Sequence
  Peptide Derived from Human Papillomavirus
LLLIVILWVIATSPL

SEQ ID NO: 47261 - protein, 15 aa, Artificial Sequence
  Peptide Derived from Human Papillomavirus
LRCFCIYVVFIYIPL

SEQ ID NO: 47262 - protein, 15 aa, Artificial Sequence
  Peptide Derived from Human Papillomavirus
LWVIATSPLRCFCIY

SEQ ID NO: 47263 - protein, 15 aa, Artificial Sequence
  Peptide Derived from Human Papillomavirus
MIELNISTVSIVLCF

SEQ ID NO: 47264 - protein, 15 aa, Artificial Sequence
  Peptide Derived from Human Papillomavirus
PLFVIHTHASFLSQQ

SEQ ID NO: 47265 - protein, 15 aa, Artificial Sequence
  Peptide Derived from Human Papillomavirus
RPLVLSVSVYATLLL

SEQ ID NO: 47266 - protein, 15 aa, Artificial Sequence
  Peptide Derived from Human Papillomavirus
SIVLCFLLCFCVLLF

SEQ ID NO: 47267 - protein, 15 aa, Artificial Sequence
  Peptide Derived from Human Papillomavirus
SVSVYATLLLLIVIL

SEQ ID NO: 47268 - protein, 15 aa, Artificial Sequence
  Peptide Derived from Human Papillomavirus
TLLLLIVILWVIATS

SEQ ID NO: 47269 - protein, 15 aa, Artificial Sequence
  Peptide Derived from Human Papillomavirus
TSPLRCFCIYVVFIY

SEQ ID NO: 47270 - protein, 15 aa, Artificial Sequence
  Peptide Derived from Human Papillomavirus
TVSIVLCFLLCFCVL

SEQ ID NO: 47271 - protein, 15 aa, Artificial Sequence
  Peptide Derived from Human Papillomavirus
VCLVIRPLVLSVSVY

SEQ ID NO: 47272 - protein, 15 aa, Artificial Sequence
  Peptide Derived from Human Papillomavirus
VFIYIPLFVIHTHAS

SEQ ID NO: 47273 - protein, 15 aa, Artificial Sequence
  Peptide Derived from Human Papillomavirus
VILWVIATSPLRCFC

SEQ ID NO: 47274 - protein, 15 aa, Artificial Sequence
  Peptide Derived from Human Papillomavirus
VLCFLLCFCVLLFVC

SEQ ID NO: 47275 - protein, 15 aa, Artificial Sequence
  Peptide Derived from Human Papillomavirus
VLLFVCLVIRPLVLS

SEQ ID NO: 47276 - protein, 15 aa, Artificial Sequence
  Peptide Derived from Human Papillomavirus
VLSVSVYATLLLLIV

SEQ ID NO: 47277 - protein, 15 aa, Artificial Sequence
  Peptide Derived from Human Papillomavirus
VSIVLCFLLCFCVLL

SEQ ID NO: 47278 - protein, 15 aa, Artificial Sequence
  Peptide Derived from Human Papillomavirus
VSVYATLLLLIVILW

SEQ ID NO: 47279 - protein, 15 aa, Artificial Sequence
  Peptide Derived from Human Papillomavirus
YATLLLLIVILWVIA

SEQ ID NO: 47280 - protein, 15 aa, Artificial Sequence
  Peptide Derived from Human Papillomavirus
YIPLFVIHTHASFLS

SEQ ID NO: 47281 - protein, 15 aa, Artificial Sequence
  Peptide Derived from Human Papillomavirus
YVVFIYIPLFVIHTH

SEQ ID NO: 47282 - protein, 15 aa, Artificial Sequence
  Peptide Derived from Human Papillomavirus
  VARIANT 1, 2, 3: Xaa= Any amino acid
XXXMFKNPAERPRKL

SEQ ID NO: 47283 - protein, 15 aa, Artificial Sequence
  Peptide Derived from Human Papillomavirus
ALEIPYDELRLNCVY

SEQ ID NO: 47284 - protein, 15 aa, Artificial Sequence
  Peptide Derived from Human Papillomavirus
CDLLIRCITCQRPLC

SEQ ID NO: 47285 - protein, 15 aa, Artificial Sequence
  Peptide Derived from Human Papillomavirus
CLRFYSKVSEFRWYR

SEQ ID NO: 47286 - protein, 15 aa, Artificial Sequence
  Peptide Derived from Human Papillomavirus
DFAFTDLTIVYRDDT

SEQ ID NO: 47287 - protein, 15 aa, Artificial Sequence
  Peptide Derived from Human Papillomavirus
DLLIRCITCQRPLCP

SEQ ID NO: 47288 - protein, 15 aa, Artificial Sequence
  Peptide Derived from Human Papillomavirus
EFRWYRYSVYGTTLE

SEQ ID NO: 47289 - protein, 15 aa, Artificial Sequence
  Peptide Derived from Human Papillomavirus
EIPYDELRLNCVYCK

SEQ ID NO: 47290 - protein, 15 aa, Artificial Sequence
  Peptide Derived from Human Papillomavirus
ELRLNCVYCKGQLTE

SEQ ID NO: 47291 - protein, 15 aa, Artificial Sequence
  Peptide Derived from Human Papillomavirus
FHNIGGRWTGRCIAC

SEQ ID NO: 47292 - protein, 15 aa, Artificial Sequence
  Peptide Derived from Human Papillomavirus
GGRWTGRCIACWRRP

SEQ ID NO: 47293 - protein, 13 aa, Artificial Sequence
  Peptide Derived from Human Papillomavirus
IACWRRPRTETQV

SEQ ID NO: 47294 - protein, 15 aa, Artificial Sequence
  Peptide Derived from Human Papillomavirus
ICDLLIRCITCQRPL

SEQ ID NO: 47295 - protein, 15 aa, Artificial Sequence
  Peptide Derived from Human Papillomavirus
IRCITCQRPLCPEEK

SEQ ID NO: 47296 - protein, 15 aa, Artificial Sequence
  Peptide Derived from Human Papillomavirus
KGQLTETEVLDFAFT

SEQ ID NO: 47297 - protein, 15 aa, Artificial Sequence
  Peptide Derived from Human Papillomavirus
LEKLTNKGICDLLIR

SEQ ID NO: 47298 - protein, 15 aa, Artificial Sequence
  Peptide Derived from Human Papillomavirus
LTIVYRDDTPHGVCT

SEQ ID NO: 47299 - protein, 15 aa, Artificial Sequence
  Peptide Derived from Human Papillomavirus
NCVYCKGQLTETEVL

SEQ ID NO: 47300 - protein, 15 aa, Artificial Sequence
  Peptide Derived from Human Papillomavirus
NKGICDLLIRCITCQ

SEQ ID NO: 47301 - protein, 15 aa, Artificial Sequence
  Peptide Derived from Human Papillomavirus
PHGVCTKCLRFYSKV

SEQ ID NO: 47302 - protein, 15 aa, Artificial Sequence
  Peptide Derived from Human Papillomavirus
PRKLHELSSALEIPY

SEQ ID NO: 47303 - protein, 15 aa, Artificial Sequence
  Peptide Derived from Human Papillomavirus
RYSVYGTTLEKLTNK

SEQ ID NO: 47304 - protein, 15 aa, Artificial Sequence
  Peptide Derived from Human Papillomavirus
TEVLDFAFTDLTIVY

SEQ ID NO: 47305 - protein, 15 aa, Artificial Sequence
  Peptide Derived from Human Papillomavirus
TIVYRDDTPHGVCTK

SEQ ID NO: 47306 - protein, 15 aa, Artificial Sequence
  Peptide Derived from Human Papillomavirus
VLDFAFTDLTIVYRD

SEQ ID NO: 47307 - protein, 15 aa, Artificial Sequence
  Peptide Derived from Human Papillomavirus
WYRYSVYGTTLEKLT

SEQ ID NO: 47308 - protein, 15 aa, Artificial Sequence
  Peptide Derived from Human Papillomavirus
YDELRLNCVYCKGQL

SEQ ID NO: 47309 - protein, 15 aa, Artificial Sequence
  Peptide Derived from Human Papillomavirus
  VARIANT 1, 2, 3: Xaa= Any amino acid
XXXMRGETPTLQDYV

SEQ ID NO: 47310 - protein, 15 aa, Artificial Sequence
  Peptide Derived from Human Papillomavirus
DIRILQELLMGSFGI

SEQ ID NO: 47311 - protein, 15 aa, Artificial Sequence
  Peptide Derived from Human Papillomavirus
EEDVIDSPAGQAEPD

SEQ ID NO: 47312 - protein, 15 aa, Artificial Sequence
  Peptide Derived from Human Papillomavirus
ELLMGSFGIVCPNCS

SEQ ID NO: 47313 - protein, 12 aa, Artificial Sequence
  Peptide Derived from Human Papillomavirus
FGIVCPNCSTRL

SEQ ID NO: 47314 - protein, 15 aa, Artificial Sequence
  Peptide Derived from Human Papillomavirus
IRILQELLMGSFGIV

SEQ ID NO: 47315 - protein, 15 aa, Artificial Sequence
  Peptide Derived from Human Papillomavirus
MGSFGIVCPNCSTRL

SEQ ID NO: 47316 - protein, 15 aa, Artificial Sequence
  Peptide Derived from Human Papillomavirus
NYNIVTFCCQCKSTL

SEQ ID NO: 47317 - protein, 15 aa, Artificial Sequence
  Peptide Derived from Human Papillomavirus
QDYVLDLQPEATDLH

SEQ ID NO: 47318 - protein, 15 aa, Artificial Sequence
  Peptide Derived from Human Papillomavirus
RLCVQSTQVDIRILQ

SEQ ID NO: 47319 - protein, 13 aa, Artificial Sequence
  Peptide Derived from Human Papillomavirus
SFGIVCPNCSTRL

SEQ ID NO: 47320 - protein, 15 aa, Artificial Sequence
  Peptide Derived from Human Papillomavirus
STQVDIRILQELLMG

SEQ ID NO: 47321 - protein, 15 aa, Artificial Sequence
  Peptide Derived from Human Papillomavirus
TLRLCVQSTQVDIRI

SEQ ID NO: 47322 - protein, 15 aa, Artificial Sequence
  Peptide Derived from Human Papillomavirus
TPTLQDYVLDLQPEA

SEQ ID NO: 47323 - protein, 15 aa, Artificial Sequence
  Peptide Derived from Human Papillomavirus
VLDLQPEATDLHCYE

SEQ ID NO: 47324 - protein, 15 aa, Artificial Sequence
  Peptide Derived from Human Papillomavirus
  VARIANT 1, 2, 3: Xaa= Any amino acid
XXXMSLWRPSEATVY

SEQ ID NO: 47325 - protein, 15 aa, Artificial Sequence
  Peptide Derived from Human Papillomavirus
ADIMTYIHSMNPAIL

SEQ ID NO: 47326 - protein, 15 aa, Artificial Sequence
  Peptide Derived from Human Papillomavirus
ARLLTVGHPYYSIPK

SEQ ID NO: 47327 - protein, 15 aa, Artificial Sequence
  Peptide Derived from Human Papillomavirus
ATVYLPPVPVSKVVS

SEQ ID NO: 47328 - protein, 15 aa, Artificial Sequence
  Peptide Derived from Human Papillomavirus
CAAIANSDTTFKSSN

SEQ ID NO: 47329 - protein, 15 aa, Artificial Sequence
  Peptide Derived from Human Papillomavirus
CISMDYKQTQLCLLG

SEQ ID NO: 47330 - protein, 15 aa, Artificial Sequence
  Peptide Derived from Human Papillomavirus
CPPLELKNSVIQDGD

SEQ ID NO: 47331 - protein, 15 aa, Artificial Sequence
  Peptide Derived from Human Papillomavirus
DEYVTRTNIYYHAGS

SEQ ID NO: 47332 - protein, 15 aa, Artificial Sequence
  Peptide Derived from Human Papillomavirus
DLQFIFQLCKITLSA

SEQ ID NO: 47333 - protein, 15 aa, Artificial Sequence
  Peptide Derived from Human Papillomavirus
DLYIKGSGSTATLAN

SEQ ID NO: 47334 - protein, 15 aa, Artificial Sequence
  Peptide Derived from Human Papillomavirus
DTSFYNPETQRLVWA

SEQ ID NO: 47335 - protein, 15 aa, Artificial Sequence
  Peptide Derived from Human Papillomavirus
DWNFGLTTPPSGSLE

SEQ ID NO: 47336 - protein, 15 aa, Artificial Sequence
  Peptide Derived from Human Papillomavirus
DYVFWEVNLKEKFSA

SEQ ID NO: 47337 - protein, 15 aa, Artificial Sequence
  Peptide Derived from Human Papillomavirus
EATVYLPPVPVSKVV

SEQ ID NO: 47338 - protein, 15 aa, Artificial Sequence
  Peptide Derived from Human Papillomavirus
EDTYRFVTSQAITCQ

SEQ ID NO: 47339 - protein, 15 aa, Artificial Sequence
  Peptide Derived from Human Papillomavirus
EVNLKEKFSADLDQF

SEQ ID NO: 47340 - protein, 15 aa, Artificial Sequence
  Peptide Derived from Human Papillomavirus
FFYLRREQMFVRHFF

SEQ ID NO: 47341 - protein, 15 aa, Artificial Sequence
  Peptide Derived from Human Papillomavirus
FGAMDFTALQDTKSN

SEQ ID NO: 47342 - protein, 15 aa, Artificial Sequence
  Peptide Derived from Human Papillomavirus
FKDYVFWEVNLKEKF

SEQ ID NO: 47343 - protein, 15 aa, Artificial Sequence
  Peptide Derived from Human Papillomavirus
FTALQDTKSNVPLDI

SEQ ID NO: 47344 - protein, 15 aa, Artificial Sequence
  Peptide Derived from Human Papillomavirus
GEEFDLQFIFQLCKI

SEQ ID NO: 47345 - protein, 15 aa, Artificial Sequence
  Peptide Derived from Human Papillomavirus
GEHWGKGSPCSNNAI

SEQ ID NO: 47346 - protein, 15 aa, Artificial Sequence
  Peptide Derived from Human Papillomavirus
GLEVGRGQPLGVGIS

SEQ ID NO: 47347 - protein, 15 aa, Artificial Sequence
  Peptide Derived from Human Papillomavirus
GLQYRVFRVRLPDPN

SEQ ID NO: 47348 - protein, 15 aa, Artificial Sequence
  Peptide Derived from Human Papillomavirus
GNQLFVTVVDTTRST

SEQ ID NO: 47349 - protein, 15 aa, Artificial Sequence
  Peptide Derived from Human Papillomavirus
GQPLGVGISGHPLLN

SEQ ID NO: 47350 - protein, 15 aa, Artificial Sequence
  Peptide Derived from Human Papillomavirus
GVGISGHPLLNKFDD

SEQ ID NO: 47351 - protein, 15 aa, Artificial Sequence
  Peptide Derived from Human Papillomavirus
HPYYSIPKSDNPKKI

SEQ ID NO: 47352 - protein, 15 aa, Artificial Sequence
  Peptide Derived from Human Papillomavirus
IFQLCKITLSADIMT

SEQ ID NO: 47353 - protein, 15 aa, Artificial Sequence
  Peptide Derived from Human Papillomavirus
IHSMNPAILEDWNFG

SEQ ID NO: 47354 - protein, 15 aa, Artificial Sequence
  Peptide Derived from Human Papillomavirus
KITLSADIMTYIHSM

SEQ ID NO: 47355 - protein, 15 aa, Artificial Sequence
  Peptide Derived from Human Papillomavirus
KKIVVPKVSGLQYRV

SEQ ID NO: 47356 - protein, 15 aa, Artificial Sequence
  Peptide Derived from Human Papillomavirus
KSNVPLDICNSICKY

SEQ ID NO: 47357 - protein, 15 aa, Artificial Sequence
  Peptide Derived from Human Papillomavirus
LCLLGCKPPIGEHWG

SEQ ID NO: 47358 - protein, 15 aa, Artificial Sequence
  Peptide Derived from Human Papillomavirus
LEDWNFGLTTPPSGS

SEQ ID NO: 47359 - protein, 15 aa, Artificial Sequence
  Peptide Derived from Human Papillomavirus
LPPVPVSKVVSTDEY

SEQ ID NO: 47360 - protein, 15 aa, Artificial Sequence
  Peptide Derived from Human Papillomavirus
MSLWRPSEATVYLPP

SEQ ID NO: 47361 - protein, 15 aa, Artificial Sequence
  Peptide Derived from Human Papillomavirus
MTYIHSMNPAILEDW

SEQ ID NO: 47362 - protein, 15 aa, Artificial Sequence
  Peptide Derived from Human Papillomavirus
NFGLTTPPSGSLEDT

SEQ ID NO: 47363 - protein, 15 aa, Artificial Sequence
  Peptide Derived from Human Papillomavirus
NIYYHAGSARLLTVG

SEQ ID NO: 47364 - protein, 15 aa, Artificial Sequence
  Peptide Derived from Human Papillomavirus
NKPYWMQRAQGHNNG

SEQ ID NO: 47365 - protein, 15 aa, Artificial Sequence
  Peptide Derived from Human Papillomavirus
NMSVCAAIANSDTTF

SEQ ID NO: 47366 - protein, 15 aa, Artificial Sequence
  Peptide Derived from Human Papillomavirus
NNAITPGDCPPLELK

SEQ ID NO: 47367 - protein, 15 aa, Artificial Sequence
  Peptide Derived from Human Papillomavirus
NSTYFPTPSGSMVTS

SEQ ID NO: 47368 - protein, 15 aa, Artificial Sequence
  Peptide Derived from Human Papillomavirus
NSVIQDGDMVDTGFG

SEQ ID NO: 47369 - protein, 15 aa, Artificial Sequence
  Peptide Derived from Human Papillomavirus
NVPLDICNSICKYPD

SEQ ID NO: 47370 - protein, 15 aa, Artificial Sequence
  Peptide Derived from Human Papillomavirus
PKKIVVPKVSGLQYR

SEQ ID NO: 47371 - protein, 15 aa, Artificial Sequence
  Peptide Derived from Human Papillomavirus
PLDICNSICKYPDYL

SEQ ID NO: 47372 - protein, 15 aa, Artificial Sequence
  Peptide Derived from Human Papillomavirus
PLELKNSVIQDGDMV

SEQ ID NO: 47373 - protein, 15 aa, Artificial Sequence
  Peptide Derived from Human Papillomavirus
PNKFGFPDTSFYNPE

SEQ ID NO: 47374 - protein, 15 aa, Artificial Sequence
  Peptide Derived from Human Papillomavirus
PTDLYIKGSGSTATL

SEQ ID NO: 47375 - protein, 15 aa, Artificial Sequence
  Peptide Derived from Human Papillomavirus
PVPVSKVVSTDEYVT

SEQ ID NO: 47376 - protein, 15 aa, Artificial Sequence
  Peptide Derived from Human Papillomavirus
QFIFQLCKITLSADI

SEQ ID NO: 47377 - protein, 15 aa, Artificial Sequence
  Peptide Derived from Human Papillomavirus
QFPLGRKFLLQAGYR

SEQ ID NO: 47378 - protein, 15 aa, Artificial Sequence
  Peptide Derived from Human Papillomavirus
QLCLLGCKPPIGEHW

SEQ ID NO: 47379 - protein, 15 aa, Artificial Sequence
  Peptide Derived from Human Papillomavirus
QLFVTVVDTTRSTNM

SEQ ID NO: 47380 - protein, 15 aa, Artificial Sequence
  Peptide Derived from Human Papillomavirus
QTQLCLLGCKPPIGE

SEQ ID NO: 47381 - protein, 15 aa, Artificial Sequence
  Peptide Derived from Human Papillomavirus
QYRVFRVRLPDPNKF

SEQ ID NO: 47382 - protein, 15 aa, Artificial Sequence
  Peptide Derived from Human Papillomavirus
RHFFNRSGTVGESVP

SEQ ID NO: 47383 - protein, 15 aa, Artificial Sequence
  Peptide Derived from Human Papillomavirus
RLVWACVGLEVGRGQ

SEQ ID NO: 47384 - protein, 15 aa, Artificial Sequence
  Peptide Derived from Human Papillomavirus
SADLDQFPLGRKFLL

SEQ ID NO: 47385 - protein, 15 aa, Artificial Sequence
  Peptide Derived from Human Papillomavirus
SGSMVTSDAQIFNKP

SEQ ID NO: 47386 - protein, 15 aa, Artificial Sequence
  Peptide Derived from Human Papillomavirus
SGTVGESVPTDLYIK

SEQ ID NO: 47387 - protein, 15 aa, Artificial Sequence
  Peptide Derived from Human Papillomavirus
SMDYKQTQLCLLGCK

SEQ ID NO: 47388 - protein, 15 aa, Artificial Sequence
  Peptide Derived from Human Papillomavirus
SQAITCQKTAPQKPK

SEQ ID NO: 47389 - protein, 15 aa, Artificial Sequence
  Peptide Derived from Human Papillomavirus
STNMSVCAAIANSDT

SEQ ID NO: 47390 - protein, 15 aa, Artificial Sequence
  Peptide Derived from Human Papillomavirus
TNIYYHAGSARLLTV

SEQ ID NO: 47391 - protein, 15 aa, Artificial Sequence
  Peptide Derived from Human Papillomavirus
TQRLVWACVGLEVGR

SEQ ID NO: 47392 - protein, 15 aa, Artificial Sequence
  Peptide Derived from Human Papillomavirus
TVYLPPVPVSKVVST

SEQ ID NO: 47393 - protein, 15 aa, Artificial Sequence
  Peptide Derived from Human Papillomavirus
TYRFVTSQAITCQKT

SEQ ID NO: 47394 - protein, 15 aa, Artificial Sequence
  Peptide Derived from Human Papillomavirus
VFRVRLPDPNKFGFP

SEQ ID NO: 47395 - protein, 15 aa, Artificial Sequence
  Peptide Derived from Human Papillomavirus
VTVVDTTRSTNMSVC

SEQ ID NO: 47396 - protein, 15 aa, Artificial Sequence
  Peptide Derived from Human Papillomavirus
YPDYLKMVAEPYGDT

SEQ ID NO: 47397 - protein, 15 aa, Artificial Sequence
  Peptide Derived from Human Papillomavirus
YRFVTSQAITCQKTA

SEQ ID NO: 47398 - protein, 15 aa, Artificial Sequence
  Peptide Derived from Human Papillomavirus
YRVFRVRLPDPNKFG

SEQ ID NO: 47399 - protein, 15 aa, Artificial Sequence
  Peptide Derived from Human Papillomavirus
  VARIANT 1, 2, 3: Xaa= Any amino acid
XXXMRSKRSTKRTKR

SEQ ID NO: 47400 - protein, 15 aa, Artificial Sequence
  Peptide Derived from Human Papillomavirus
ADQILRYGSMGVFFG

SEQ ID NO: 47401 - protein, 15 aa, Artificial Sequence
  Peptide Derived from Human Papillomavirus
DFTVDTPATHNVSPS

SEQ ID NO: 47402 - protein, 15 aa, Artificial Sequence
  Peptide Derived from Human Papillomavirus
DPDFLDIIALHRPAL

SEQ ID NO: 47403 - protein, 15 aa, Artificial Sequence
  Peptide Derived from Human Papillomavirus
DPSVLQPPTPAETSG

SEQ ID NO: 47404 - protein, 15 aa, Artificial Sequence
  Peptide Derived from Human Papillomavirus
DQILRYGSMGVFFGG

SEQ ID NO: 47405 - protein, 15 aa, Artificial Sequence
  Peptide Derived from Human Papillomavirus
DTDFTVDTPATHNVS

SEQ ID NO: 47406 - protein, 15 aa, Artificial Sequence
  Peptide Derived from Human Papillomavirus
DVPIEHAPTQVFPFP

SEQ ID NO: 47407 - protein, 15 aa, Artificial Sequence
  Peptide Derived from Human Papillomavirus
EASIPIRPPVSIDPV

SEQ ID NO: 47408 - protein, 15 aa, Artificial Sequence
  Peptide Derived from Human Papillomavirus
EESLYFSNTSHNIAP

SEQ ID NO: 47409 - protein, 15 aa, Artificial Sequence
  Peptide Derived from Human Papillomavirus
EIPMDTFIVSTNNEN

SEQ ID NO: 47410 - protein, 15 aa, Artificial Sequence
  Peptide Derived from Human Papillomavirus
ESGIVDVGAPAPIPH

SEQ ID NO: 47411 - protein, 15 aa, Artificial Sequence
  Peptide Derived from Human Papillomavirus
ESLYFSNTSHNIAPD

SEQ ID NO: 47412 - protein, 15 aa, Artificial Sequence
  Peptide Derived from Human Papillomavirus
GESIEMQPLGASATT

SEQ ID NO: 47413 - protein, 15 aa, Artificial Sequence
  Peptide Derived from Human Papillomavirus
GGDFYLHPSYYMLKR

SEQ ID NO: 47414 - protein, 15 aa, Artificial Sequence
  Peptide Derived from Human Papillomavirus
GHLLLSSSSISTHNY

SEQ ID NO: 47415 - protein, 15 aa, Artificial Sequence
  Peptide Derived from Human Papillomavirus
GPDVPIEHAPTQVFP

SEQ ID NO: 47416 - protein, 15 aa, Artificial Sequence
  Peptide Derived from Human Papillomavirus
GVFFGGLGIGSGSGT

SEQ ID NO: 47417 - protein, 15 aa, Artificial Sequence
  Peptide Derived from Human Papillomavirus
HLLLSSSSISTHNYE

SEQ ID NO: 47418 - protein, 15 aa, Artificial Sequence
  Peptide Derived from Human Papillomavirus
HTTIADQILRYGSMG

SEQ ID NO: 47419 - protein, 15 aa, Artificial Sequence
  Peptide Derived from Human Papillomavirus
HYYYDISSINPAGES

SEQ ID NO: 47420 - protein, 15 aa, Artificial Sequence
  Peptide Derived from Human Papillomavirus
IDPVGPLDPSIVSLV

SEQ ID NO: 47421 - protein, 15 aa, Artificial Sequence
  Peptide Derived from Human Papillomavirus
IIALHRPALTSRRNT

SEQ ID NO: 47422 - protein, 15 aa, Artificial Sequence
  Peptide Derived from Human Papillomavirus
ILDVTSVSTHENPTF

SEQ ID NO: 47423 - protein, 15 aa, Artificial Sequence
  Peptide Derived from Human Papillomavirus
ILRYGSMGVFFGGLG

SEQ ID NO: 47424 - protein, 15 aa, Artificial Sequence
  Peptide Derived from Human Papillomavirus
IPIFSGPDVPIEHAP

SEQ ID NO: 47425 - protein, 15 aa, Artificial Sequence
  Peptide Derived from Human Papillomavirus
IPKIEHTTIADQILR

SEQ ID NO: 47426 - protein, 15 aa, Artificial Sequence
  Peptide Derived from Human Papillomavirus
IVDVGAPAPIPHPPT

SEQ ID NO: 47427 - protein, 15 aa, Artificial Sequence
  Peptide Derived from Human Papillomavirus
KQLITYENPAYETVN

SEQ ID NO: 47428 - protein, 15 aa, Artificial Sequence
  Peptide Derived from Human Papillomavirus
LDIIALHRPALTSRR

SEQ ID NO: 47429 - protein, 15 aa, Artificial Sequence
  Peptide Derived from Human Papillomavirus
MQPLGASATTTSTLN

SEQ ID NO: 47430 - protein, 15 aa, Artificial Sequence
  Peptide Derived from Human Papillomavirus
NDGLYDIYADTDFTV

SEQ ID NO: 47431 - protein, 15 aa, Artificial Sequence
  Peptide Derived from Human Papillomavirus
NENITSSTPIPGVRR

SEQ ID NO: 47432 - protein, 15 aa, Artificial Sequence
  Peptide Derived from Human Papillomavirus
NPAYETVNAEESLYF

SEQ ID NO: 47433 - protein, 15 aa, Artificial Sequence
  Peptide Derived from Human Papillomavirus
NPTFTDPSVLQPPTP

SEQ ID NO: 47434 - protein, 15 aa, Artificial Sequence
  Peptide Derived from Human Papillomavirus
PAILDVTSVSTHENP

SEQ ID NO: 47435 - protein, 15 aa, Artificial Sequence
  Peptide Derived from Human Papillomavirus
PAPIPHPPTTSGFDI

SEQ ID NO: 47436 - protein, 15 aa, Artificial Sequence
  Peptide Derived from Human Papillomavirus
PDFLDIIALHRPALT

SEQ ID NO: 47437 - protein, 15 aa, Artificial Sequence
  Peptide Derived from Human Papillomavirus
PFPLAPTTPQVSIFV

SEQ ID NO: 47438 - protein, 15 aa, Artificial Sequence
  Peptide Derived from Human Papillomavirus
PSTVSEASIPIRPPV

SEQ ID NO: 47439 - protein, 15 aa, Artificial Sequence
  Peptide Derived from Human Papillomavirus
PSVLQPPTPAETSGH

SEQ ID NO: 47440 - protein, 15 aa, Artificial Sequence
  Peptide Derived from Human Papillomavirus
PTQVFPFPLAPTTPQ

SEQ ID NO: 47441 - protein, 15 aa, Artificial Sequence
  Peptide Derived from Human Papillomavirus
PVSIDPVGPLDPSIV

SEQ ID NO: 47442 - protein, 15 aa, Artificial Sequence
  Peptide Derived from Human Papillomavirus
RKRVSYFFTDVSVAA

SEQ ID NO: 47443 - protein, 15 aa, Artificial Sequence
  Peptide Derived from Human Papillomavirus
RLGLYSKATQQVKVI

SEQ ID NO: 47444 - protein, 15 aa, Artificial Sequence
  Peptide Derived from Human Papillomavirus
RNTVRYSRLGNKQTL

SEQ ID NO: 47445 - protein, 15 aa, Artificial Sequence
  Peptide Derived from Human Papillomavirus
RPPVSIDPVGPLDPS

SEQ ID NO: 47446 - protein, 15 aa, Artificial Sequence
  Peptide Derived from Human Papillomavirus
RTGYVPLSTRPSTVS

SEQ ID NO: 47447 - protein, 15 aa, Artificial Sequence
  Peptide Derived from Human Papillomavirus
RVHYYYDISSINPAG

SEQ ID NO: 47448 - protein, 13 aa, Artificial Sequence
  Peptide Derived from Human Papillomavirus
RVSYFFTDVSVAA

SEQ ID NO: 47449 - protein, 15 aa, Artificial Sequence
  Peptide Derived from Human Papillomavirus
SAYVPTNTTVPLSTG

SEQ ID NO: 47450 - protein, 15 aa, Artificial Sequence
  Peptide Derived from Human Papillomavirus
SGHLLLSSSSISTHN

SEQ ID NO: 47451 - protein, 15 aa, Artificial Sequence
  Peptide Derived from Human Papillomavirus
SGIVDVGAPAPIPHP

SEQ ID NO: 47452 - protein, 15 aa, Artificial Sequence
  Peptide Derived from Human Papillomavirus
SIEMQPLGASATTTS

SEQ ID NO: 47453 - protein, 15 aa, Artificial Sequence
  Peptide Derived from Human Papillomavirus
SIPIRPPVSIDPVGP

SEQ ID NO: 47454 - protein, 15 aa, Artificial Sequence
  Peptide Derived from Human Papillomavirus
SMGVFFGGLGIGSGS

SEQ ID NO: 47455 - protein, 15 aa, Artificial Sequence
  Peptide Derived from Human Papillomavirus
STAVQSTSAVSAYVP

SEQ ID NO: 47456 - protein, 15 aa, Artificial Sequence
  Peptide Derived from Human Papillomavirus
THNVSPSTAVQSTSA

SEQ ID NO: 47457 - protein, 15 aa, Artificial Sequence
  Peptide Derived from Human Papillomavirus
THNYEEIPMDTFIVS

SEQ ID NO: 47458 - protein, 15 aa, Artificial Sequence
  Peptide Derived from Human Papillomavirus
TPAILDVTSVSTHEN

SEQ ID NO: 47459 - protein, 15 aa, Artificial Sequence
  Peptide Derived from Human Papillomavirus
TQLYQTCKAAGTCPS

SEQ ID NO: 47460 - protein, 15 aa, Artificial Sequence
  Peptide Derived from Human Papillomavirus
TQQVKVIDPTFLSAP

SEQ ID NO: 47461 - protein, 15 aa, Artificial Sequence
  Peptide Derived from Human Papillomavirus
TQVFPFPLAPTTPQV

SEQ ID NO: 47462 - protein, 15 aa, Artificial Sequence
  Peptide Derived from Human Papillomavirus
TSAVSAYVPTNTTVP

SEQ ID NO: 47463 - protein, 15 aa, Artificial Sequence
  Peptide Derived from Human Papillomavirus
TSGFDIATTADTTPA

SEQ ID NO: 47464 - protein, 15 aa, Artificial Sequence
  Peptide Derived from Human Papillomavirus
VFPFPLAPTTPQVSI

SEQ ID NO: 47465 - protein, 15 aa, Artificial Sequence
  Peptide Derived from Human Papillomavirus
VGPLDPSIVSLVEES

SEQ ID NO: 47466 - protein, 15 aa, Artificial Sequence
  Peptide Derived from Human Papillomavirus
VHYYYDISSINPAGE

SEQ ID NO: 47467 - protein, 15 aa, Artificial Sequence
  Peptide Derived from Human Papillomavirus
VKVIDPTFLSAPKQL

SEQ ID NO: 47468 - protein, 15 aa, Artificial Sequence
  Peptide Derived from Human Papillomavirus
VSAYVPTNTTVPLST

SEQ ID NO: 47469 - protein, 15 aa, Artificial Sequence
  Peptide Derived from Human Papillomavirus
VSLVEESGIVDVGAP

SEQ ID NO: 47470 - protein, 12 aa, Artificial Sequence
  Peptide Derived from Human Papillomavirus
VSYFFTDVSVAA

SEQ ID NO: 47471 - protein, 15 aa, Artificial Sequence
  Peptide Derived from Human Papillomavirus
YETVNAEESLYFSNT

SEQ ID NO: 47472 - protein, 15 aa, Artificial Sequence
  Peptide Derived from Human Papillomavirus
YSRLGNKQTLRTRSG

SEQ ID NO: 47473 - protein, 15 aa, Artificial Sequence
  Peptide Derived from Human Papillomavirus
YVPLSTRPSTVSEAS

SEQ ID NO: 47474 - protein, 15 aa, Artificial Sequence
  Peptide Derived from Human Papillomavirus
YYDISSINPAGESIE

SEQ ID NO: 47475 - protein, 15 aa, Artificial Sequence
  Peptide Derived from Human Papillomavirus
AAAFLKSNSQAKIVK

SEQ ID NO: 47476 - protein, 15 aa, Artificial Sequence
  Peptide Derived from Human Papillomavirus
AEDVVDRAANPCRTS

SEQ ID NO: 47477 - protein, 15 aa, Artificial Sequence
  Peptide Derived from Human Papillomavirus
AKIVKDCGIMCRHYK

SEQ ID NO: 47478 - protein, 15 aa, Artificial Sequence
  Peptide Derived from Human Papillomavirus
AKLMSNLLSIPETCM

SEQ ID NO: 47479 - protein, 15 aa, Artificial Sequence
  Peptide Derived from Human Papillomavirus
ALYWFRTAMSNISDV

SEQ ID NO: 47480 - protein, 15 aa, Artificial Sequence
  Peptide Derived from Human Papillomavirus
AYGISFMELVRPFKS

SEQ ID NO: 47481 - protein, 15 aa, Artificial Sequence
  Peptide Derived from Human Papillomavirus
CALYWFRTAMSNISD

SEQ ID NO: 47482 - protein, 15 aa, Artificial Sequence
  Peptide Derived from Human Papillomavirus
CENVTLQEISNVLHS

SEQ ID NO: 47483 - protein, 15 aa, Artificial Sequence
  Peptide Derived from Human Papillomavirus
CMVIEPPKLRSQTCA

SEQ ID NO: 47484 - protein, 15 aa, Artificial Sequence
  Peptide Derived from Human Papillomavirus
CTGWFEVEAVIERRT

SEQ ID NO: 47485 - protein, 15 aa, Artificial Sequence
  Peptide Derived from Human Papillomavirus
DENWKSFFSRTWCKL

SEQ ID NO: 47486 - protein, 15 aa, Artificial Sequence
  Peptide Derived from Human Papillomavirus
DIAYYYAQLADSNSN

SEQ ID NO: 47487 - protein, 15 aa, Artificial Sequence
  Peptide Derived from Human Papillomavirus
DNIFDLSEMVQWAYD

SEQ ID NO: 47488 - protein, 15 aa, Artificial Sequence
  Peptide Derived from Human Papillomavirus
DRGIIILLLIRFRCS

SEQ ID NO: 47489 - protein, 15 aa, Artificial Sequence
  Peptide Derived from Human Papillomavirus
DSDIAYYYAQLADSN

SEQ ID NO: 47490 - protein, 15 aa, Artificial Sequence
  Peptide Derived from Human Papillomavirus
DSGYGNTEVETQQMV

SEQ ID NO: 47491 - protein, 15 aa, Artificial Sequence
  Peptide Derived from Human Papillomavirus
DSRWPYLHSRLTVFE

SEQ ID NO: 47492 - protein, 15 aa, Artificial Sequence
  Peptide Derived from Human Papillomavirus
DTNLNDLESSGVGDD

SEQ ID NO: 47493 - protein, 15 aa, Artificial Sequence
  Peptide Derived from Human Papillomavirus
DWCITGYGISPSVAE

SEQ ID NO: 47494 - protein, 15 aa, Artificial Sequence
  Peptide Derived from Human Papillomavirus
ECTYRKRKIDELEDS

SEQ ID NO: 47495 - protein, 15 aa, Artificial Sequence
  Peptide Derived from Human Papillomavirus
EDDLNAVCALKRKFA

SEQ ID NO: 47496 - protein, 15 aa, Artificial Sequence
  Peptide Derived from Human Papillomavirus
ETCMVIEPPKLRSQT

SEQ ID NO: 47497 - protein, 15 aa, Artificial Sequence
  Peptide Derived from Human Papillomavirus
FKKFLKGIPKKSCML

SEQ ID NO: 47498 - protein, 15 aa, Artificial Sequence
  Peptide Derived from Human Papillomavirus
GCVISCVNSKSHFWL

SEQ ID NO: 47499 - protein, 15 aa, Artificial Sequence
  Peptide Derived from Human Papillomavirus
GGNISTFKCSAGENT

SEQ ID NO: 47500 - protein, 15 aa, Artificial Sequence
  Peptide Derived from Human Papillomavirus
GKSYFGMSLIQFLKG

SEQ ID NO: 47501 - protein, 15 aa, Artificial Sequence
  Peptide Derived from Human Papillomavirus
GYGISPSVAESLKVL

SEQ ID NO: 47502 - protein, 15 aa, Artificial Sequence
  Peptide Derived from Human Papillomavirus
HRALVQLKCPPLLLT

SEQ ID NO: 47503 - protein, 15 aa, Artificial Sequence
  Peptide Derived from Human Papillomavirus
HSLYTHLQCLTCDRG

SEQ ID NO: 47504 - protein, 15 aa, Artificial Sequence
  Peptide Derived from Human Papillomavirus
IAYYYAQLADSNSNA

SEQ ID NO: 47505 - protein, 15 aa, Artificial Sequence
  Peptide Derived from Human Papillomavirus
IDDYMRNALDGNEIS

SEQ ID NO: 47506 - protein, 15 aa, Artificial Sequence
  Peptide Derived from Human Papillomavirus
IGMIDDVTPISWTYI

SEQ ID NO: 47507 - protein, 15 aa, Artificial Sequence
  Peptide Derived from Human Papillomavirus
IGQWIQSRCEKTNDG

SEQ ID NO: 47508 - protein, 15 aa, Artificial Sequence
  Peptide Derived from Human Papillomavirus
ILLLIRFRCSKNRLT

SEQ ID NO: 47509 - protein, 15 aa, Artificial Sequence
  Peptide Derived from Human Papillomavirus
IQFLKGCVISCVNSK

SEQ ID NO: 47510 - protein, 15 aa, Artificial Sequence
  Peptide Derived from Human Papillomavirus
ISDVQGTTPEWIDRL

SEQ ID NO: 47511 - protein, 15 aa, Artificial Sequence
  Peptide Derived from Human Papillomavirus
ISFMELVRPFKSDKT

SEQ ID NO: 47512 - protein, 15 aa, Artificial Sequence
  Peptide Derived from Human Papillomavirus
ITGYGISPSVAESLK

SEQ ID NO: 47513 - protein, 15 aa, Artificial Sequence
  Peptide Derived from Human Papillomavirus
KEAYGISFMELVRPF

SEQ ID NO: 47514 - protein, 15 aa, Artificial Sequence
  Peptide Derived from Human Papillomavirus
KIGMIDDVTPISWTY

SEQ ID NO: 47515 - protein, 15 aa, Artificial Sequence
  Peptide Derived from Human Papillomavirus
KNRLTVAKLMSNLLS

SEQ ID NO: 47516 - protein, 15 aa, Artificial Sequence
  Peptide Derived from Human Papillomavirus
KSCMLICGPANTGKS

SEQ ID NO: 47517 - protein, 15 aa, Artificial Sequence
  Peptide Derived from Human Papillomavirus
KSFFSRTWCKLDLIE

SEQ ID NO: 47518 - protein, 15 aa, Artificial Sequence
  Peptide Derived from Human Papillomavirus
KSHFWLQPLSDAKIG

SEQ ID NO: 47519 - protein, 15 aa, Artificial Sequence
  Peptide Derived from Human Papillomavirus
KSYFGMSLIQFLKGC

SEQ ID NO: 47520 - protein, 15 aa, Artificial Sequence
  Peptide Derived from Human Papillomavirus
KVLIKQHSLYTHLQC

SEQ ID NO: 47521 - protein, 15 aa, Artificial Sequence
  Peptide Derived from Human Papillomavirus
LIQFLKGCVISCVNS

SEQ ID NO: 47522 - protein, 15 aa, Artificial Sequence
  Peptide Derived from Human Papillomavirus
LKGIPKKSCMLICGP

SEQ ID NO: 47523 - protein, 15 aa, Artificial Sequence
  Peptide Derived from Human Papillomavirus
LKVLIKQHSLYTHLQ

SEQ ID NO: 47524 - protein, 15 aa, Artificial Sequence
  Peptide Derived from Human Papillomavirus
LLEFIDDSMENSIQA

SEQ ID NO: 47525 - protein, 15 aa, Artificial Sequence
  Peptide Derived from Human Papillomavirus
LLLIRFRCSKNRLTV

SEQ ID NO: 47526 - protein, 15 aa, Artificial Sequence
  Peptide Derived from Human Papillomavirus
LLSIPETCMVIEPPK

SEQ ID NO: 47527 - protein, 15 aa, Artificial Sequence
  Peptide Derived from Human Papillomavirus
LNDLESSGVGDDSEV

SEQ ID NO: 47528 - protein, 15 aa, Artificial Sequence
  Peptide Derived from Human Papillomavirus
LQPLSDAKIGMIDDV

SEQ ID NO: 47529 - protein, 15 aa, Artificial Sequence
  Peptide Derived from Human Papillomavirus
LTVFEFKNPFPFDEN

SEQ ID NO: 47530 - protein, 15 aa, Artificial Sequence
  Peptide Derived from Human Papillomavirus
LVQLKCPPLLLTSNT

SEQ ID NO: 47531 - protein, 15 aa, Artificial Sequence
  Peptide Derived from Human Papillomavirus
LYWFRTAMSNISDVQ

SEQ ID NO: 47532 - protein, 15 aa, Artificial Sequence
  Peptide Derived from Human Papillomavirus
MELVRPFKSDKTSCT

SEQ ID NO: 47533 - protein, 15 aa, Artificial Sequence
  Peptide Derived from Human Papillomavirus
NILYKFKEAYGISFM

SEQ ID NO: 47534 - protein, 15 aa, Artificial Sequence
  Peptide Derived from Human Papillomavirus
NTEVETQQMVQQVES

SEQ ID NO: 47535 - protein, 15 aa, Artificial Sequence
  Peptide Derived from Human Papillomavirus
PEWIDRLTVLQHSFN

SEQ ID NO: 47536 - protein, 15 aa, Artificial Sequence
  Peptide Derived from Human Papillomavirus
PPKLRSQTCALYWFR

SEQ ID NO: 47537 - protein, 15 aa, Artificial Sequence
  Peptide Derived from Human Papillomavirus
PPLLLTSNTNAGTDS

SEQ ID NO: 47538 - protein, 15 aa, Artificial Sequence
  Peptide Derived from Human Papillomavirus
QQMVQQVESQNGDTN

SEQ ID NO: 47539 - protein, 15 aa, Artificial Sequence
  Peptide Derived from Human Papillomavirus
QWAYDNELTDDSDIA

SEQ ID NO: 47540 - protein, 15 aa, Artificial Sequence
  Peptide Derived from Human Papillomavirus
RALVQLKCPPLLLTS

SEQ ID NO: 47541 - protein, 15 aa, Artificial Sequence
  Peptide Derived from Human Papillomavirus
RGIIILLLIRFRCSK

SEQ ID NO: 47542 - protein, 15 aa, Artificial Sequence
  Peptide Derived from Human Papillomavirus
RLTVAKLMSNLLSIP

SEQ ID NO: 47543 - protein, 15 aa, Artificial Sequence
  Peptide Derived from Human Papillomavirus
RNALDGNEISIDVKH

SEQ ID NO: 47544 - protein, 15 aa, Artificial Sequence
  Peptide Derived from Human Papillomavirus
RWPYLHSRLTVFEFK

SEQ ID NO: 47545 - protein, 15 aa, Artificial Sequence
  Peptide Derived from Human Papillomavirus
SCMLICGPANTGKSY

SEQ ID NO: 47546 - protein, 15 aa, Artificial Sequence
  Peptide Derived from Human Papillomavirus
SHFWLQPLSDAKIGM

SEQ ID NO: 47547 - protein, 15 aa, Artificial Sequence
  Peptide Derived from Human Papillomavirus
SIDVKHRALVQLKCP

SEQ ID NO: 47548 - protein, 15 aa, Artificial Sequence
  Peptide Derived from Human Papillomavirus
SNLLSIPETCMVIEP

SEQ ID NO: 47549 - protein, 15 aa, Artificial Sequence
  Peptide Derived from Human Papillomavirus
SNVLHSSNTKANILY

SEQ ID NO: 47550 - protein, 15 aa, Artificial Sequence
  Peptide Derived from Human Papillomavirus
SRTWCKLDLIEEEDK

SEQ ID NO: 47551 - protein, 15 aa, Artificial Sequence
  Peptide Derived from Human Papillomavirus
SWTYIDDYMRNALDG

SEQ ID NO: 47552 - protein, 15 aa, Artificial Sequence
  Peptide Derived from Human Papillomavirus
TCALYWFRTAMSNIS

SEQ ID NO: 47553 - protein, 15 aa, Artificial Sequence
  Peptide Derived from Human Papillomavirus
TGWFEVEAVIERRTG

SEQ ID NO: 47554 - protein, 15 aa, Artificial Sequence
  Peptide Derived from Human Papillomavirus
TPEWIDRLTVLQHSF

SEQ ID NO: 47555 - protein, 15 aa, Artificial Sequence
  Peptide Derived from Human Papillomavirus
VAKLMSNLLSIPETC

SEQ ID NO: 47556 - protein, 15 aa, Artificial Sequence
  Peptide Derived from Human Papillomavirus
VCALKRKFAACSQSA

SEQ ID NO: 47557 - protein, 15 aa, Artificial Sequence
  Peptide Derived from Human Papillomavirus
VEAVIERRTGDNISE

SEQ ID NO: 47558 - protein, 15 aa, Artificial Sequence
  Peptide Derived from Human Papillomavirus
VFEFKNPFPFDENGN

SEQ ID NO: 47559 - protein, 15 aa, Artificial Sequence
  Peptide Derived from Human Papillomavirus
VQLLRYQNIEFTAFL

SEQ ID NO: 47560 - protein, 15 aa, Artificial Sequence
  Peptide Derived from Human Papillomavirus
VRPFKSDKTSCTDWC

SEQ ID NO: 47561 - protein, 15 aa, Artificial Sequence
  Peptide Derived from Human Papillomavirus
VTPISWTYIDDYMRN

SEQ ID NO: 47562 - protein, 15 aa, Artificial Sequence
  Peptide Derived from Human Papillomavirus
WPYLHSRLTVFEFKN

SEQ ID NO: 47563 - protein, 15 aa, Artificial Sequence
  Peptide Derived from Human Papillomavirus
YAQLADSNSNAAAFL

SEQ ID NO: 47564 - protein, 15 aa, Artificial Sequence
  Peptide Derived from Human Papillomavirus
YTHLQCLTCDRGIII

SEQ ID NO: 47565 - protein, 15 aa, Artificial Sequence
  Peptide Derived from Human Papillomavirus
  VARIANT 1, 2, 3: Xaa= Any amino acid
XXXMEEISARLNAVQ

SEQ ID NO: 47566 - protein, 15 aa, Artificial Sequence
  Peptide Derived from Human Papillomavirus
AAKYSKTQMWEVHVG

SEQ ID NO: 47567 - protein, 15 aa, Artificial Sequence
  Peptide Derived from Human Papillomavirus
AFQVIELQMALETLS

SEQ ID NO: 47568 - protein, 15 aa, Artificial Sequence
  Peptide Derived from Human Papillomavirus
AKQMGFSHLCHQVVP

SEQ ID NO: 47569 - protein, 15 aa, Artificial Sequence
  Peptide Derived from Human Papillomavirus
ALLYTAKQMGFSHLC

SEQ ID NO: 47570 - protein, 15 aa, Artificial Sequence
  Peptide Derived from Human Papillomavirus
AQPLTKLFCADPALD

SEQ ID NO: 47571 - protein, 15 aa, Artificial Sequence
  Peptide Derived from Human Papillomavirus
CHQVVPSLLASKTKA

SEQ ID NO: 47572 - protein, 15 aa, Artificial Sequence
  Peptide Derived from Human Papillomavirus
DPALDNRTARTATNC

SEQ ID NO: 47573 - protein, 15 aa, Artificial Sequence
  Peptide Derived from Human Papillomavirus
EIYIIEEDTCTMVTG

SEQ ID NO: 47574 - protein, 15 aa, Artificial Sequence
  Peptide Derived from Human Papillomavirus
EKILDLYEADKTDLP

SEQ ID NO: 47575 - protein, 15 aa, Artificial Sequence
  Peptide Derived from Human Papillomavirus
ELQMALETLSKSQYS

SEQ ID NO: 47576 - protein, 15 aa, Artificial Sequence
  Peptide Derived from Human Papillomavirus
EVHVGGQVIVCPTSI

SEQ ID NO: 47577 - protein, 15 aa, Artificial Sequence
  Peptide Derived from Human Papillomavirus
FKYFKEDAAKYSKTQ

SEQ ID NO: 47578 - protein, 15 aa, Artificial Sequence
  Peptide Derived from Human Papillomavirus
FQVIELQMALETLSK

SEQ ID NO: 47579 - protein, 15 aa, Artificial Sequence
  Peptide Derived from Human Papillomavirus
FSHLCHQVVPSLLAS

SEQ ID NO: 47580 - protein, 15 aa, Artificial Sequence
  Peptide Derived from Human Papillomavirus
GGQVIVCPTSISSNQ

SEQ ID NO: 47581 - protein, 15 aa, Artificial Sequence
  Peptide Derived from Human Papillomavirus
GQVIVCPTSISSNQI

SEQ ID NO: 47582 - protein, 15 aa, Artificial Sequence
  Peptide Derived from Human Papillomavirus
HQVVPSLLASKTKAF

SEQ ID NO: 47583 - protein, 15 aa, Artificial Sequence
  Peptide Derived from Human Papillomavirus
HWKLIRMECALLYTA

SEQ ID NO: 47584 - protein, 15 aa, Artificial Sequence
  Peptide Derived from Human Papillomavirus
IEHWKLIRMECALLY

SEQ ID NO: 47585 - protein, 15 aa, Artificial Sequence
  Peptide Derived from Human Papillomavirus
IGMYYIHNCEKVYFK

SEQ ID NO: 47586 - protein, 15 aa, Artificial Sequence
  Peptide Derived from Human Papillomavirus
IYIIEEDTCTMVTGK

SEQ ID NO: 47587 - protein, 15 aa, Artificial Sequence
  Peptide Derived from Human Papillomavirus
KELYSSMSSTWHWTS

SEQ ID NO: 47588 - protein, 15 aa, Artificial Sequence
  Peptide Derived from Human Papillomavirus
KTQMWEVHVGGQVIV

SEQ ID NO: 47589 - protein, 15 aa, Artificial Sequence
  Peptide Derived from Human Papillomavirus
LDLYEADKTDLPSQI

SEQ ID NO: 47590 - protein, 15 aa, Artificial Sequence
  Peptide Derived from Human Papillomavirus
LEVWLCEPPKCFKKQ

SEQ ID NO: 47591 - protein, 15 aa, Artificial Sequence
  Peptide Derived from Human Papillomavirus
LGTVKIPPTVQISTG

SEQ ID NO: 47592 - protein, 15 aa, Artificial Sequence
  Peptide Derived from Human Papillomavirus
LIRMECALLYTAKQM

SEQ ID NO: 47593 - protein, 15 aa, Artificial Sequence
  Peptide Derived from Human Papillomavirus
LKPYKELYSSMSSTW

SEQ ID NO: 47594 - protein, 15 aa, Artificial Sequence
  Peptide Derived from Human Papillomavirus
LNAVQEKILDLYEAD

SEQ ID NO: 47595 - protein, 15 aa, Artificial Sequence
  Peptide Derived from Human Papillomavirus
LTKLFCADPALDNRT

SEQ ID NO: 47596 - protein, 15 aa, Artificial Sequence
  Peptide Derived from Human Papillomavirus
NGIVTVTFVTEQQQQ

SEQ ID NO: 47597 - protein, 15 aa, Artificial Sequence
  Peptide Derived from Human Papillomavirus
PSQIEHWKLIRMECA

SEQ ID NO: 47598 - protein, 15 aa, Artificial Sequence
  Peptide Derived from Human Papillomavirus
PTSISSNQISTTETA

SEQ ID NO: 47599 - protein, 15 aa, Artificial Sequence
  Peptide Derived from Human Papillomavirus
QMFLGTVKIPPTVQI

SEQ ID NO: 47600 - protein, 15 aa, Artificial Sequence
  Peptide Derived from Human Papillomavirus
QQQMFLGTVKIPPTV

SEQ ID NO: 47601 - protein, 15 aa, Artificial Sequence
  Peptide Derived from Human Papillomavirus
QRTVCSSNVAPIVHL

SEQ ID NO: 47602 - protein, 15 aa, Artificial Sequence
  Peptide Derived from Human Papillomavirus
QTSLEVWLCEPPKCF

SEQ ID NO: 47603 - protein, 15 aa, Artificial Sequence
  Peptide Derived from Human Papillomavirus
QVIVCPTSISSNQIS

SEQ ID NO: 47604 - protein, 15 aa, Artificial Sequence
  Peptide Derived from Human Papillomavirus
QWTLQQTSLEVWLCE

SEQ ID NO: 47605 - protein, 15 aa, Artificial Sequence
  Peptide Derived from Human Papillomavirus
SLEVWLCEPPKCFKK

SEQ ID NO: 47606 - protein, 15 aa, Artificial Sequence
  Peptide Derived from Human Papillomavirus
SNQISTTETADIQTD

SEQ ID NO: 47607 - protein, 15 aa, Artificial Sequence
  Peptide Derived from Human Papillomavirus
TCTMVTGKVDYIGMY

SEQ ID NO: 47608 - protein, 15 aa, Artificial Sequence
  Peptide Derived from Human Papillomavirus
TGKVDYIGMYYIHNC

SEQ ID NO: 47609 - protein, 15 aa, Artificial Sequence
  Peptide Derived from Human Papillomavirus
TKAFQVIELQMALET

SEQ ID NO: 47610 - protein, 15 aa, Artificial Sequence
  Peptide Derived from Human Papillomavirus
TKLFCADPALDNRTA

SEQ ID NO: 47611 - protein, 15 aa, Artificial Sequence
  Peptide Derived from Human Papillomavirus
TSQWTLQQTSLEVWL

SEQ ID NO: 47612 - protein, 15 aa, Artificial Sequence
  Peptide Derived from Human Papillomavirus
VDYIGMYYIHNCEKV

SEQ ID NO: 47613 - protein, 15 aa, Artificial Sequence
  Peptide Derived from Human Papillomavirus
VPSLLASKTKAFQVI

SEQ ID NO: 47614 - protein, 15 aa, Artificial Sequence
  Peptide Derived from Human Papillomavirus
WKLIRMECALLYTAK

SEQ ID NO: 47615 - protein, 15 aa, Artificial Sequence
  Peptide Derived from Human Papillomavirus
YFKYFKEDAAKYSKT

SEQ ID NO: 47616 - protein, 15 aa, Artificial Sequence
  Peptide Derived from Human Papillomavirus
YKELYSSMSSTWHWT

SEQ ID NO: 47617 - protein, 15 aa, Artificial Sequence
  Peptide Derived from Human Papillomavirus
YTNWGEIYIIEEDTC

SEQ ID NO: 47618 - protein, 15 aa, Artificial Sequence
  Peptide Derived from Human Papillomavirus
  VARIANT 1, 2, 3: Xaa= Any amino acid
XXXMIFVFVLCFILF

SEQ ID NO: 47619 - protein, 15 aa, Artificial Sequence
  Peptide Derived from Human Papillomavirus
  VARIANT 1, 2: Xaa= Any amino acid
XXMIFVFVLCFILFL

SEQ ID NO: 47620 - protein, 15 aa, Artificial Sequence
  Peptide Derived from Human Papillomavirus
  VARIANT 1: Xaa= Any amino acid
XMIFVFVLCFILFLC

SEQ ID NO: 47621 - protein, 15 aa, Artificial Sequence
  Peptide Derived from Human Papillomavirus
AWLLVLVLLLWVFVG

SEQ ID NO: 47622 - protein, 15 aa, Artificial Sequence
  Peptide Derived from Human Papillomavirus
CFILFLCLSLLLRPL

SEQ ID NO: 47623 - protein, 13 aa, Artificial Sequence
  Peptide Derived from Human Papillomavirus
CINFHAQHMTQQE

SEQ ID NO: 47624 - protein, 15 aa, Artificial Sequence
  Peptide Derived from Human Papillomavirus
CLSLLLRPLILSIST

SEQ ID NO: 47625 - protein, 15 aa, Artificial Sequence
  Peptide Derived from Human Papillomavirus
CYLLFLYLPMMCINF

SEQ ID NO: 47626 - protein, 15 aa, Artificial Sequence
  Peptide Derived from Human Papillomavirus
FCYLLFLYLPMMCIN

SEQ ID NO: 47627 - protein, 15 aa, Artificial Sequence
  Peptide Derived from Human Papillomavirus
FILFLCLSLLLRPLI

SEQ ID NO: 47628 - protein, 15 aa, Artificial Sequence
  Peptide Derived from Human Papillomavirus
FLYLPMMCINFHAQH

SEQ ID NO: 47629 - protein, 15 aa, Artificial Sequence
  Peptide Derived from Human Papillomavirus
FVFVLCFILFLCLSL

SEQ ID NO: 47630 - protein, 15 aa, Artificial Sequence
  Peptide Derived from Human Papillomavirus
GSPLKIFFCYLLFLY

SEQ ID NO: 47631 - protein, 15 aa, Artificial Sequence
  Peptide Derived from Human Papillomavirus
IFVFVLCFILFLCLS

SEQ ID NO: 47632 - protein, 15 aa, Artificial Sequence
  Peptide Derived from Human Papillomavirus
ILFLCLSLLLRPLIL

SEQ ID NO: 47633 - protein, 15 aa, Artificial Sequence
  Peptide Derived from Human Papillomavirus
ISTYAWLLVLVLLLW

SEQ ID NO: 47634 - protein, 15 aa, Artificial Sequence
  Peptide Derived from Human Papillomavirus
LCFILFLCLSLLLRP

SEQ ID NO: 47635 - protein, 15 aa, Artificial Sequence
  Peptide Derived from Human Papillomavirus
LFLYLPMMCINFHAQ

SEQ ID NO: 47636 - protein, 15 aa, Artificial Sequence
  Peptide Derived from Human Papillomavirus
LKIFFCYLLFLYLPM

SEQ ID NO: 47637 - protein, 15 aa, Artificial Sequence
  Peptide Derived from Human Papillomavirus
LLFLYLPMMCINFHA

SEQ ID NO: 47638 - protein, 15 aa, Artificial Sequence
  Peptide Derived from Human Papillomavirus
LLLWVFVGSPLKIFF

SEQ ID NO: 47639 - protein, 15 aa, Artificial Sequence
  Peptide Derived from Human Papillomavirus
LLWVFVGSPLKIFFC

SEQ ID NO: 47640 - protein, 15 aa, Artificial Sequence
  Peptide Derived from Human Papillomavirus
LRPLILSISTYAWLL

SEQ ID NO: 47641 - protein, 15 aa, Artificial Sequence
  Peptide Derived from Human Papillomavirus
LSLLLRPLILSISTY

SEQ ID NO: 47642 - protein, 15 aa, Artificial Sequence
  Peptide Derived from Human Papillomavirus
LVLLLWVFVGSPLKI

SEQ ID NO: 47643 - protein, 15 aa, Artificial Sequence
  Peptide Derived from Human Papillomavirus
LVLVLLLWVFVGSPL

SEQ ID NO: 47644 - protein, 15 aa, Artificial Sequence
  Peptide Derived from Human Papillomavirus
LWVFVGSPLKIFFCY

SEQ ID NO: 47645 - protein, 15 aa, Artificial Sequence
  Peptide Derived from Human Papillomavirus
PLKIFFCYLLFLYLP

SEQ ID NO: 47646 - protein, 15 aa, Artificial Sequence
  Peptide Derived from Human Papillomavirus
RPLILSISTYAWLLV

SEQ ID NO: 47647 - protein, 15 aa, Artificial Sequence
  Peptide Derived from Human Papillomavirus
SLLLRPLILSISTYA

SEQ ID NO: 47648 - protein, 15 aa, Artificial Sequence
  Peptide Derived from Human Papillomavirus
TYAWLLVLVLLLWVF

SEQ ID NO: 47649 - protein, 15 aa, Artificial Sequence
  Peptide Derived from Human Papillomavirus
VLCFILFLCLSLLLR

SEQ ID NO: 47650 - protein, 15 aa, Artificial Sequence
  Peptide Derived from Human Papillomavirus
WLLVLVLLLWVFVGS

SEQ ID NO: 47651 - protein, 15 aa, Artificial Sequence
  Peptide Derived from Human Papillomavirus
YAWLLVLVLLLWVFV

SEQ ID NO: 47652 - protein, 15 aa, Artificial Sequence
  Peptide Derived from Human Papillomavirus
YLLFLYLPMMCINFH

SEQ ID NO: 47653 - protein, 15 aa, Artificial Sequence
  Peptide Derived from Human Papillomavirus
CLRFLSKISEYRHYN

SEQ ID NO: 47654 - protein, 15 aa, Artificial Sequence
  Peptide Derived from Human Papillomavirus
DFAFADLTVVYREGN

SEQ ID NO: 47655 - protein, 15 aa, Artificial Sequence
  Peptide Derived from Human Papillomavirus
EILIRCIICQRPLCP

SEQ ID NO: 47656 - protein, 15 aa, Artificial Sequence
  Peptide Derived from Human Papillomavirus
ETTIHNIELQCVECK

SEQ ID NO: 47657 - protein, 15 aa, Artificial Sequence
  Peptide Derived from Human Papillomavirus
FHNISGRWAGRCAAC

SEQ ID NO: 47658 - protein, 15 aa, Artificial Sequence
  Peptide Derived from Human Papillomavirus
GNPFGICKLCLRFLS

SEQ ID NO: 47659 - protein, 15 aa, Artificial Sequence
  Peptide Derived from Human Papillomavirus
ICKLCLRFLSKISEY

SEQ ID NO: 47660 - protein, 15 aa, Artificial Sequence
  Peptide Derived from Human Papillomavirus
IHNIELQCVECKKPL

SEQ ID NO: 47661 - protein, 15 aa, Artificial Sequence
  Peptide Derived from Human Papillomavirus
IRCIICQRPLCPQEK

SEQ ID NO: 47662 - protein, 15 aa, Artificial Sequence
  Peptide Derived from Human Papillomavirus
KKPLNEILIRCIICQ

SEQ ID NO: 47663 - protein, 15 aa, Artificial Sequence
  Peptide Derived from Human Papillomavirus
KKPLQRSEVYDFAFA

SEQ ID NO: 47664 - protein, 15 aa, Artificial Sequence
  Peptide Derived from Human Papillomavirus
LNEILIRCIICQRPL

SEQ ID NO: 47665 - protein, 15 aa, Artificial Sequence
  Peptide Derived from Human Papillomavirus
LQCVECKKPLQRSEV

SEQ ID NO: 47666 - protein, 15 aa, Artificial Sequence
  Peptide Derived from Human Papillomavirus
NEILIRCIICQRPLC

SEQ ID NO: 47667 - protein, 15 aa, Artificial Sequence
  Peptide Derived from Human Papillomavirus
NIELQCVECKKPLQR

SEQ ID NO: 47668 - protein, 15 aa, Artificial Sequence
  Peptide Derived from Human Papillomavirus
NYSVYGNTLEQTVKK

SEQ ID NO: 47669 - protein, 15 aa, Artificial Sequence
  Peptide Derived from Human Papillomavirus
PFGICKLCLRFLSKI

SEQ ID NO: 47670 - protein, 15 aa, Artificial Sequence
  Peptide Derived from Human Papillomavirus
RCIICQRPLCPQEKK

SEQ ID NO: 47671 - protein, 15 aa, Artificial Sequence
  Peptide Derived from Human Papillomavirus
SEVYDFAFADLTVVY

SEQ ID NO: 47672 - protein, 15 aa, Artificial Sequence
  Peptide Derived from Human Papillomavirus
SGRWAGRCAACWRSR

SEQ ID NO: 47673 - protein, 15 aa, Artificial Sequence
  Peptide Derived from Human Papillomavirus
TVVYREGNPFGICKL

SEQ ID NO: 47674 - protein, 15 aa, Artificial Sequence
  Peptide Derived from Human Papillomavirus
VYDFAFADLTVVYRE

SEQ ID NO: 47675 - protein, 15 aa, Artificial Sequence
  Peptide Derived from Human Papillomavirus
  VARIANT 1, 2, 3: Xaa= Any amino acid
XXXMRGHKPTLKEYV

SEQ ID NO: 47676 - protein, 15 aa, Artificial Sequence
  Peptide Derived from Human Papillomavirus
ADYYIVTCCHTCNTT

SEQ ID NO: 47677 - protein, 15 aa, Artificial Sequence
  Peptide Derived from Human Papillomavirus
IQQLLMGTVNIVCPT

SEQ ID NO: 47678 - protein, 15 aa, Artificial Sequence
  Peptide Derived from Human Papillomavirus
KEYVLDLYPEPTDLY

SEQ ID NO: 47679 - protein, 15 aa, Artificial Sequence
  Peptide Derived from Human Papillomavirus
KPTLKEYVLDLYPEP

SEQ ID NO: 47680 - protein, 15 aa, Artificial Sequence
  Peptide Derived from Human Papillomavirus
LRTIQQLLMGTVNIV

SEQ ID NO: 47681 - protein, 14 aa, Artificial Sequence
  Peptide Derived from Human Papillomavirus
MGTVNIVCPTCAQQ

SEQ ID NO: 47682 - protein, 15 aa, Artificial Sequence
  Peptide Derived from Human Papillomavirus
QLLMGTVNIVCPTCA

SEQ ID NO: 47683 - protein, 15 aa, Artificial Sequence
  Peptide Derived from Human Papillomavirus
RLCVNSTASDLRTIQ

SEQ ID NO: 47684 - protein, 15 aa, Artificial Sequence
  Peptide Derived from Human Papillomavirus
TADYYIVTCCHTCNT

SEQ ID NO: 47685 - protein, 15 aa, Artificial Sequence
  Peptide Derived from Human Papillomavirus
TDLYCYEQLSDSSDE

SEQ ID NO: 47686 - protein, 12 aa, Artificial Sequence
  Peptide Derived from Human Papillomavirus
TVNIVCPTCAQQ

SEQ ID NO: 47687 - protein, 15 aa, Artificial Sequence
  Peptide Derived from Human Papillomavirus
TVRLCVNSTASDLRT

SEQ ID NO: 47688 - protein, 15 aa, Artificial Sequence
  Peptide Derived from Human Papillomavirus
VLDLYPEPTDLYCYE

SEQ ID NO: 47689 - protein, 15 aa, Artificial Sequence
  Peptide Derived from Human Papillomavirus
YYIVTCCHTCNTTVR

SEQ ID NO: 47690 - protein, 15 aa, Artificial Sequence
  Peptide Derived from Human Papillomavirus
  VARIANT 1, 2, 3: Xaa= Any amino acid
XXXMSVWRPSEATVY

SEQ ID NO: 47691 - protein, 15 aa, Artificial Sequence
  Peptide Derived from Human Papillomavirus
AEVMTYIHAMNPDIL

SEQ ID NO: 47692 - protein, 15 aa, Artificial Sequence
  Peptide Derived from Human Papillomavirus
AGTLGEAVPDDLYIK

SEQ ID NO: 47693 - protein, 15 aa, Artificial Sequence
  Peptide Derived from Human Papillomavirus
AKKLLVPKVSGLQYR

SEQ ID NO: 47694 - protein, 15 aa, Artificial Sequence
  Peptide Derived from Human Papillomavirus
ATVYLPPVPVSKVVS

SEQ ID NO: 47695 - protein, 15 aa, Artificial Sequence
  Peptide Derived from Human Papillomavirus
CLSMDYKQTQLCLLG

SEQ ID NO: 47696 - protein, 15 aa, Artificial Sequence
  Peptide Derived from Human Papillomavirus
CMDFKTLQANKSDVP

SEQ ID NO: 47697 - protein, 15 aa, Artificial Sequence
  Peptide Derived from Human Papillomavirus
CPPLELINTIIEDGD

SEQ ID NO: 47698 - protein, 15 aa, Artificial Sequence
  Peptide Derived from Human Papillomavirus
CTQVTSDSTYKNENF

SEQ ID NO: 47699 - protein, 15 aa, Artificial Sequence
  Peptide Derived from Human Papillomavirus
DEYVSRTSIYYYAGS

SEQ ID NO: 47700 - protein, 15 aa, Artificial Sequence
  Peptide Derived from Human Papillomavirus
DLQFVFQLCKVTLTA

SEQ ID NO: 47701 - protein, 15 aa, Artificial Sequence
  Peptide Derived from Human Papillomavirus
DLYIKGSGTTASIQS

SEQ ID NO: 47702 - protein, 15 aa, Artificial Sequence
  Peptide Derived from Human Papillomavirus
DTSFYNPDTQRLVWA

SEQ ID NO: 47703 - protein, 15 aa, Artificial Sequence
  Peptide Derived from Human Papillomavirus
DVPIDICGSTCKYPD

SEQ ID NO: 47704 - protein, 15 aa, Artificial Sequence
  Peptide Derived from Human Papillomavirus
DWQFGLTPPPSASLQ

SEQ ID NO: 47705 - protein, 15 aa, Artificial Sequence
  Peptide Derived from Human Papillomavirus
EATVYLPPVPVSKVV

SEQ ID NO: 47706 - protein, 15 aa, Artificial Sequence
  Peptide Derived from Human Papillomavirus
EVDLKEKFSADLDQF

SEQ ID NO: 47707 - protein, 15 aa, Artificial Sequence
  Peptide Derived from Human Papillomavirus
FFFLRREQMFVRHFF

SEQ ID NO: 47708 - protein, 15 aa, Artificial Sequence
  Peptide Derived from Human Papillomavirus
FGCMDFKTLQANKSD

SEQ ID NO: 47709 - protein, 15 aa, Artificial Sequence
  Peptide Derived from Human Papillomavirus
FKTLQANKSDVPIDI

SEQ ID NO: 47710 - protein, 15 aa, Artificial Sequence
  Peptide Derived from Human Papillomavirus
GEHWGKGVACTNAAP

SEQ ID NO: 47711 - protein, 15 aa, Artificial Sequence
  Peptide Derived from Human Papillomavirus
GKGVACTNAAPANDC

SEQ ID NO: 47712 - protein, 15 aa, Artificial Sequence
  Peptide Derived from Human Papillomavirus
GLEIGRGQPLGVGIS

SEQ ID NO: 47713 - protein, 15 aa, Artificial Sequence
  Peptide Derived from Human Papillomavirus
GLQYRVFRVRLPDPN

SEQ ID NO: 47714 - protein, 15 aa, Artificial Sequence
  Peptide Derived from Human Papillomavirus
GNQVFVTVVDTTRST

SEQ ID NO: 47715 - protein, 15 aa, Artificial Sequence
  Peptide Derived from Human Papillomavirus
GQPLGVGISGHPLLN

SEQ ID NO: 47716 - protein, 15 aa, Artificial Sequence
  Peptide Derived from Human Papillomavirus
GVGISGHPLLNKFDD

SEQ ID NO: 47717 - protein, 15 aa, Artificial Sequence
  Peptide Derived from Human Papillomavirus
HPYFSIKNPTNAKKL

SEQ ID NO: 47718 - protein, 15 aa, Artificial Sequence
  Peptide Derived from Human Papillomavirus
IHAMNPDILEDWQFG

SEQ ID NO: 47719 - protein, 15 aa, Artificial Sequence
  Peptide Derived from Human Papillomavirus
IRHVEEYDLQFVFQL

SEQ ID NO: 47720 - protein, 15 aa, Artificial Sequence
  Peptide Derived from Human Papillomavirus
KKLLVPKVSGLQYRV

SEQ ID NO: 47721 - protein, 15 aa, Artificial Sequence
  Peptide Derived from Human Papillomavirus
KPKLKRAAPTSTRTS

SEQ ID NO: 47722 - protein, 15 aa, Artificial Sequence
  Peptide Derived from Human Papillomavirus
KSDVPIDICGSTCKY

SEQ ID NO: 47723 - protein, 15 aa, Artificial Sequence
  Peptide Derived from Human Papillomavirus
KVTLTAEVMTYIHAM

SEQ ID NO: 47724 - protein, 15 aa, Artificial Sequence
  Peptide Derived from Human Papillomavirus
KYTFWEVDLKEKFSA

SEQ ID NO: 47725 - protein, 15 aa, Artificial Sequence
  Peptide Derived from Human Papillomavirus
LCLLGCKPPTGEHWG

SEQ ID NO: 47726 - protein, 15 aa, Artificial Sequence
  Peptide Derived from Human Papillomavirus
LEDWQFGLTPPPSAS

SEQ ID NO: 47727 - protein, 15 aa, Artificial Sequence
  Peptide Derived from Human Papillomavirus
LGKYTFWEVDLKEKF

SEQ ID NO: 47728 - protein, 15 aa, Artificial Sequence
  Peptide Derived from Human Papillomavirus
LNKFDDTETGNKYPG

SEQ ID NO: 47729 - protein, 15 aa, Artificial Sequence
  Peptide Derived from Human Papillomavirus
LPPVPVSKVVSTDEY

SEQ ID NO: 47730 - protein, 15 aa, Artificial Sequence
  Peptide Derived from Human Papillomavirus
MSVWRPSEATVYLPP

SEQ ID NO: 47731 - protein, 15 aa, Artificial Sequence
  Peptide Derived from Human Papillomavirus
MTYIHAMNPDILEDW

SEQ ID NO: 47732 - protein, 15 aa, Artificial Sequence
  Peptide Derived from Human Papillomavirus
NKPYWLQRAQGHNNG

SEQ ID NO: 47733 - protein, 15 aa, Artificial Sequence
  Peptide Derived from Human Papillomavirus
NMTLCTQVTSDSTYK

SEQ ID NO: 47734 - protein, 15 aa, Artificial Sequence
  Peptide Derived from Human Papillomavirus
NTIIEDGDMVDTGFG

SEQ ID NO: 47735 - protein, 15 aa, Artificial Sequence
  Peptide Derived from Human Papillomavirus
PDDLYIKGSGTTASI

SEQ ID NO: 47736 - protein, 15 aa, Artificial Sequence
  Peptide Derived from Human Papillomavirus
PIDICGSTCKYPDYL

SEQ ID NO: 47737 - protein, 15 aa, Artificial Sequence
  Peptide Derived from Human Papillomavirus
PLELINTIIEDGDMV

SEQ ID NO: 47738 - protein, 15 aa, Artificial Sequence
  Peptide Derived from Human Papillomavirus
PNKFGFPDTSFYNPD

SEQ ID NO: 47739 - protein, 15 aa, Artificial Sequence
  Peptide Derived from Human Papillomavirus
PVPVSKVVSTDEYVS

SEQ ID NO: 47740 - protein, 15 aa, Artificial Sequence
  Peptide Derived from Human Papillomavirus
QDTYRFVTSQAITCQ

SEQ ID NO: 47741 - protein, 15 aa, Artificial Sequence
  Peptide Derived from Human Papillomavirus
QFGLTPPPSASLQDT

SEQ ID NO: 47742 - protein, 15 aa, Artificial Sequence
  Peptide Derived from Human Papillomavirus
QFPLGRKFLLQAGLK

SEQ ID NO: 47743 - protein, 15 aa, Artificial Sequence
  Peptide Derived from Human Papillomavirus
QFVFQLCKVTLTAEV

SEQ ID NO: 47744 - protein, 15 aa, Artificial Sequence
  Peptide Derived from Human Papillomavirus
QLCLLGCKPPTGEHW

SEQ ID NO: 47745 - protein, 15 aa, Artificial Sequence
  Peptide Derived from Human Papillomavirus
QTQLCLLGCKPPTGE

SEQ ID NO: 47746 - protein, 15 aa, Artificial Sequence
  Peptide Derived from Human Papillomavirus
QVFVTVVDTTRSTNM

SEQ ID NO: 47747 - protein, 15 aa, Artificial Sequence
  Peptide Derived from Human Papillomavirus
QYRVFRVRLPDPNKF

SEQ ID NO: 47748 - protein, 15 aa, Artificial Sequence
  Peptide Derived from Human Papillomavirus
RHFFNRAGTLGEAVP

SEQ ID NO: 47749 - protein, 15 aa, Artificial Sequence
  Peptide Derived from Human Papillomavirus
RKFLLQAGLKAKPKL

SEQ ID NO: 47750 - protein, 15 aa, Artificial Sequence
  Peptide Derived from Human Papillomavirus
RLVWACVGLEIGRGQ

SEQ ID NO: 47751 - protein, 15 aa, Artificial Sequence
  Peptide Derived from Human Papillomavirus
SADLDQFPLGRKFLL

SEQ ID NO: 47752 - protein, 15 aa, Artificial Sequence
  Peptide Derived from Human Papillomavirus
SGSMVTSESQLFNKP

SEQ ID NO: 47753 - protein, 15 aa, Artificial Sequence
  Peptide Derived from Human Papillomavirus
SIYYYAGSSRLLAVG

SEQ ID NO: 47754 - protein, 15 aa, Artificial Sequence
  Peptide Derived from Human Papillomavirus
SMDYKQTQLCLLGCK

SEQ ID NO: 47755 - protein, 15 aa, Artificial Sequence
  Peptide Derived from Human Papillomavirus
SQAITCQKTVPPKEK

SEQ ID NO: 47756 - protein, 15 aa, Artificial Sequence
  Peptide Derived from Human Papillomavirus
SRLLAVGHPYFSIKN

SEQ ID NO: 47757 - protein, 15 aa, Artificial Sequence
  Peptide Derived from Human Papillomavirus
SSAFFPTPSGSMVTS

SEQ ID NO: 47758 - protein, 15 aa, Artificial Sequence
  Peptide Derived from Human Papillomavirus
TDEYVSRTSIYYYAG

SEQ ID NO: 47759 - protein, 15 aa, Artificial Sequence
  Peptide Derived from Human Papillomavirus
TQRLVWACVGLEIGR

SEQ ID NO: 47760 - protein, 15 aa, Artificial Sequence
  Peptide Derived from Human Papillomavirus
TSIYYYAGSSRLLAV

SEQ ID NO: 47761 - protein, 15 aa, Artificial Sequence
  Peptide Derived from Human Papillomavirus
TVYLPPVPVSKVVST

SEQ ID NO: 47762 - protein, 15 aa, Artificial Sequence
  Peptide Derived from Human Papillomavirus
TYRFVTSQAITCQKT

SEQ ID NO: 47763 - protein, 15 aa, Artificial Sequence
  Peptide Derived from Human Papillomavirus
VEEYDLQFVFQLCKV

SEQ ID NO: 47764 - protein, 15 aa, Artificial Sequence
  Peptide Derived from Human Papillomavirus
VFQLCKVTLTAEVMT

SEQ ID NO: 47765 - protein, 15 aa, Artificial Sequence
  Peptide Derived from Human Papillomavirus
VFRVRLPDPNKFGFP

SEQ ID NO: 47766 - protein, 15 aa, Artificial Sequence
  Peptide Derived from Human Papillomavirus
VTVVDTTRSTNMTLC

SEQ ID NO: 47767 - protein, 15 aa, Artificial Sequence
  Peptide Derived from Human Papillomavirus
YPDYLKMTSEPYGDS

SEQ ID NO: 47768 - protein, 15 aa, Artificial Sequence
  Peptide Derived from Human Papillomavirus
YRFVTSQAITCQKTV

SEQ ID NO: 47769 - protein, 15 aa, Artificial Sequence
  Peptide Derived from Human Papillomavirus
YRVFRVRLPDPNKFG

SEQ ID NO: 47770 - protein, 15 aa, Artificial Sequence
  Peptide Derived from Human Papillomavirus
  VARIANT 1, 2, 3: Xaa= Any amino acid
XXXMRHKRSTRRKRA

SEQ ID NO: 47771 - protein, 15 aa, Artificial Sequence
  Peptide Derived from Human Papillomavirus
ADDVDNVHTPMQHSY

SEQ ID NO: 47772 - protein, 15 aa, Artificial Sequence
  Peptide Derived from Human Papillomavirus
ADQILKYGSLGVFFG

SEQ ID NO: 47773 - protein, 15 aa, Artificial Sequence
  Peptide Derived from Human Papillomavirus
AIPLQPIRPPVTVDT

SEQ ID NO: 47774 - protein, 15 aa, Artificial Sequence
  Peptide Derived from Human Papillomavirus
DPDFLDIIALHRPAI

SEQ ID NO: 47775 - protein, 15 aa, Artificial Sequence
  Peptide Derived from Human Papillomavirus
DQILKYGSLGVFFGG

SEQ ID NO: 47776 - protein, 15 aa, Artificial Sequence
  Peptide Derived from Human Papillomavirus
DTFVVSTDSSNVTSS

SEQ ID NO: 47777 - protein, 15 aa, Artificial Sequence
  Peptide Derived from Human Papillomavirus
EDTLQFQHSDISPAP

SEQ ID NO: 47778 - protein, 15 aa, Artificial Sequence
  Peptide Derived from Human Papillomavirus
EPSVLHPPAPAEASG

SEQ ID NO: 47779 - protein, 15 aa, Artificial Sequence
  Peptide Derived from Human Papillomavirus
ESSIQTISTHLNPTF

SEQ ID NO: 47780 - protein, 15 aa, Artificial Sequence
  Peptide Derived from Human Papillomavirus
ETSFIEAGAPAPSIP

SEQ ID NO: 47781 - protein, 15 aa, Artificial Sequence
  Peptide Derived from Human Papillomavirus
FDTIVVDGADFVLHP

SEQ ID NO: 47782 - protein, 15 aa, Artificial Sequence
  Peptide Derived from Human Papillomavirus
FESFDPEDTLQFQHS

SEQ ID NO: 47783 - protein, 15 aa, Artificial Sequence
  Peptide Derived from Human Papillomavirus
FFPFDTIVVDGADFV

SEQ ID NO: 47784 - protein, 15 aa, Artificial Sequence
  Peptide Derived from Human Papillomavirus
FSRVGQKATLKTRSG

SEQ ID NO: 47785 - protein, 15 aa, Artificial Sequence
  Peptide Derived from Human Papillomavirus
FVPISPFFPFDTIVV

SEQ ID NO: 47786 - protein, 15 aa, Artificial Sequence
  Peptide Derived from Human Papillomavirus
GADFVLHPSYFILRR

SEQ ID NO: 47787 - protein, 15 aa, Artificial Sequence
  Peptide Derived from Human Papillomavirus
GHFIFSSPTVSTQSY

SEQ ID NO: 47788 - protein, 15 aa, Artificial Sequence
  Peptide Derived from Human Papillomavirus
GSTIADQILKYGSLG

SEQ ID NO: 47789 - protein, 15 aa, Artificial Sequence
  Peptide Derived from Human Papillomavirus
GVFFGGLGIGTGSGS

SEQ ID NO: 47790 - protein, 15 aa, Artificial Sequence
  Peptide Derived from Human Papillomavirus
HFIFSSPTVSTQSYE

SEQ ID NO: 47791 - protein, 15 aa, Artificial Sequence
  Peptide Derived from Human Papillomavirus
HKLITYDNPAFESFD

SEQ ID NO: 47792 - protein, 15 aa, Artificial Sequence
  Peptide Derived from Human Papillomavirus
HTPMQHSYSTFATTR

SEQ ID NO: 47793 - protein, 15 aa, Artificial Sequence
  Peptide Derived from Human Papillomavirus
IHYYQDLSPIVPLDH

SEQ ID NO: 47794 - protein, 15 aa, Artificial Sequence
  Peptide Derived from Human Papillomavirus
IIALHRPAITSRRHT

SEQ ID NO: 47795 - protein, 15 aa, Artificial Sequence
  Peptide Derived from Human Papillomavirus
ILKYGSLGVFFGGLG

SEQ ID NO: 47796 - protein, 15 aa, Artificial Sequence
  Peptide Derived from Human Papillomavirus
IPKVEGSTIADQILK

SEQ ID NO: 47797 - protein, 15 aa, Artificial Sequence
  Peptide Derived from Human Papillomavirus
ISPFFPFDTIVVDGA

SEQ ID NO: 47798 - protein, 15 aa, Artificial Sequence
  Peptide Derived from Human Papillomavirus
IVPLDHTVPNEQYEL

SEQ ID NO: 47799 - protein, 15 aa, Artificial Sequence
  Peptide Derived from Human Papillomavirus
IVSLIEETSFIEAGA

SEQ ID NO: 47800 - protein, 15 aa, Artificial Sequence
  Peptide Derived from Human Papillomavirus
LDIIALHRPAITSRR

SEQ ID NO: 47801 - protein, 15 aa, Artificial Sequence
  Peptide Derived from Human Papillomavirus
LQPIRPPVTVDTVGP

SEQ ID NO: 47802 - protein, 15 aa, Artificial Sequence
  Peptide Derived from Human Papillomavirus
LQPLHDTSTSSYSIN

SEQ ID NO: 47803 - protein, 15 aa, Artificial Sequence
  Peptide Derived from Human Papillomavirus
LYDVYADDVDNVHTP

SEQ ID NO: 47804 - protein, 15 aa, Artificial Sequence
  Peptide Derived from Human Papillomavirus
NDGLYDVYADDVDNV

SEQ ID NO: 47805 - protein, 15 aa, Artificial Sequence
  Peptide Derived from Human Papillomavirus
NEQYELQPLHDTSTS

SEQ ID NO: 47806 - protein, 15 aa, Artificial Sequence
  Peptide Derived from Human Papillomavirus
NIPMDTFVVSTDSSN

SEQ ID NO: 47807 - protein, 15 aa, Artificial Sequence
  Peptide Derived from Human Papillomavirus
NPAFESFDPEDTLQF

SEQ ID NO: 47808 - protein, 15 aa, Artificial Sequence
  Peptide Derived from Human Papillomavirus
NPTFTEPSVLHPPAP

SEQ ID NO: 47809 - protein, 15 aa, Artificial Sequence
  Peptide Derived from Human Papillomavirus
NTGFDTPVMSGPDIP

SEQ ID NO: 47810 - protein, 15 aa, Artificial Sequence
  Peptide Derived from Human Papillomavirus
PAIINVSSVGESSIQ

SEQ ID NO: 47811 - protein, 15 aa, Artificial Sequence
  Peptide Derived from Human Papillomavirus
PDFLDIIALHRPAIT

SEQ ID NO: 47812 - protein, 15 aa, Artificial Sequence
  Peptide Derived from Human Papillomavirus
PSGFDVTTSADTTPA

SEQ ID NO: 47813 - protein, 15 aa, Artificial Sequence
  Peptide Derived from Human Papillomavirus
PSPLFPTSSPFVPIS

SEQ ID NO: 47814 - protein, 15 aa, Artificial Sequence
  Peptide Derived from Human Papillomavirus
PSVLHPPAPAEASGH

SEQ ID NO: 47815 - protein, 15 aa, Artificial Sequence
  Peptide Derived from Human Papillomavirus
PVTVDTVGPLDSSIV

SEQ ID NO: 47816 - protein, 15 aa, Artificial Sequence
  Peptide Derived from Human Papillomavirus
QHSYSTFATTRTSNV

SEQ ID NO: 47817 - protein, 13 aa, Artificial Sequence
  Peptide Derived from Human Papillomavirus
RFPYFFTDVRVAA

SEQ ID NO: 47818 - protein, 15 aa, Artificial Sequence
  Peptide Derived from Human Papillomavirus
RHTVRFSRVGQKATL

SEQ ID NO: 47819 - protein, 15 aa, Artificial Sequence
  Peptide Derived from Human Papillomavirus
RIHYYQDLSPIVPLD

SEQ ID NO: 47820 - protein, 15 aa, Artificial Sequence
  Peptide Derived from Human Papillomavirus
RKRFPYFFTDVRVAA

SEQ ID NO: 47821 - protein, 15 aa, Artificial Sequence
  Peptide Derived from Human Papillomavirus
RLGLYSRNTQQVKVV

SEQ ID NO: 47822 - protein, 15 aa, Artificial Sequence
  Peptide Derived from Human Papillomavirus
RPPVTVDTVGPLDSS

SEQ ID NO: 47823 - protein, 15 aa, Artificial Sequence
  Peptide Derived from Human Papillomavirus
RTGYVPIGTDPPTAA

SEQ ID NO: 47824 - protein, 15 aa, Artificial Sequence
  Peptide Derived from Human Papillomavirus
SGHFIFSSPTVSTQS

SEQ ID NO: 47825 - protein, 15 aa, Artificial Sequence
  Peptide Derived from Human Papillomavirus
SLGVFFGGLGIGTGS

SEQ ID NO: 47826 - protein, 15 aa, Artificial Sequence
  Peptide Derived from Human Papillomavirus
SPFFPFDTIVVDGAD

SEQ ID NO: 47827 - protein, 15 aa, Artificial Sequence
  Peptide Derived from Human Papillomavirus
SPIVPLDHTVPNEQY

SEQ ID NO: 47828 - protein, 15 aa, Artificial Sequence
  Peptide Derived from Human Papillomavirus
SPLFPTSSPFVPISP

SEQ ID NO: 47829 - protein, 15 aa, Artificial Sequence
  Peptide Derived from Human Papillomavirus
SRPVARLGLYSRNTQ

SEQ ID NO: 47830 - protein, 15 aa, Artificial Sequence
  Peptide Derived from Human Papillomavirus
SSNVTSSTPIPGSRP

SEQ ID NO: 47831 - protein, 15 aa, Artificial Sequence
  Peptide Derived from Human Papillomavirus
SSPFVPISPFFPFDT

SEQ ID NO: 47832 - protein, 15 aa, Artificial Sequence
  Peptide Derived from Human Papillomavirus
STHLNPTFTEPSVLH

SEQ ID NO: 47833 - protein, 15 aa, Artificial Sequence
  Peptide Derived from Human Papillomavirus
STPIPGSRPVARLGL

SEQ ID NO: 47834 - protein, 15 aa, Artificial Sequence
  Peptide Derived from Human Papillomavirus
TAAIPLQPIRPPVTV

SEQ ID NO: 47835 - protein, 15 aa, Artificial Sequence
  Peptide Derived from Human Papillomavirus
TFVVSTDSSNVTSST

SEQ ID NO: 47836 - protein, 15 aa, Artificial Sequence
  Peptide Derived from Human Papillomavirus
TLQFQHSDISPAPDP

SEQ ID NO: 47837 - protein, 15 aa, Artificial Sequence
  Peptide Derived from Human Papillomavirus
TPAIINVSSVGESSI

SEQ ID NO: 47838 - protein, 15 aa, Artificial Sequence
  Peptide Derived from Human Papillomavirus
TPVMSGPDIPSPLFP

SEQ ID NO: 47839 - protein, 15 aa, Artificial Sequence
  Peptide Derived from Human Papillomavirus
TQLYQTCKATGTCPP

SEQ ID NO: 47840 - protein, 15 aa, Artificial Sequence
  Peptide Derived from Human Papillomavirus
TQQVKVVDPAFLTSP

SEQ ID NO: 47841 - protein, 15 aa, Artificial Sequence
  Peptide Derived from Human Papillomavirus
TQSYENIPMDTFVVS

SEQ ID NO: 47842 - protein, 15 aa, Artificial Sequence
  Peptide Derived from Human Papillomavirus
TSFIEAGAPAPSIPT

SEQ ID NO: 47843 - protein, 15 aa, Artificial Sequence
  Peptide Derived from Human Papillomavirus
VDTVGPLDSSIVSLI

SEQ ID NO: 47844 - protein, 15 aa, Artificial Sequence
  Peptide Derived from Human Papillomavirus
VGPLDSSIVSLIEET

SEQ ID NO: 47845 - protein, 15 aa, Artificial Sequence
  Peptide Derived from Human Papillomavirus
VKVVDPAFLTSPHKL

SEQ ID NO: 47846 - protein, 15 aa, Artificial Sequence
  Peptide Derived from Human Papillomavirus
VSSVGESSIQTISTH

SEQ ID NO: 47847 - protein, 15 aa, Artificial Sequence
  Peptide Derived from Human Papillomavirus
YQDLSPIVPLDHTVP

SEQ ID NO: 47848 - protein, 15 aa, Artificial Sequence
  Peptide Derived from Human Papillomavirus
YSTFATTRTSNVSIP

SEQ ID NO: 47849 - protein, 15 aa, Artificial Sequence
  Peptide Derived from Human Papillomavirus
YVPIGTDPPTAAIPL

SEQ ID NO: 47850 - protein, 15 aa, Artificial Sequence
  Peptide Derived from Human Papillomavirus
AAAFLKSNCQAKYLK

SEQ ID NO: 47851 - protein, 15 aa, Artificial Sequence
  Peptide Derived from Human Papillomavirus
AENVDPHCSITELKE

SEQ ID NO: 47852 - protein, 15 aa, Artificial Sequence
  Peptide Derived from Human Papillomavirus
AKYLKDCAVMCRHYK

SEQ ID NO: 47853 - protein, 15 aa, Artificial Sequence
  Peptide Derived from Human Papillomavirus
ALYWYRTGISNISEV

SEQ ID NO: 47854 - protein, 15 aa, Artificial Sequence
  Peptide Derived from Human Papillomavirus
ATLYAHIQCLDCKWG

SEQ ID NO: 47855 - protein, 15 aa, Artificial Sequence
  Peptide Derived from Human Papillomavirus
CMLIEPPKLRSSVAA

SEQ ID NO: 47856 - protein, 15 aa, Artificial Sequence
  Peptide Derived from Human Papillomavirus
CNGWFFVETIVEKKT

SEQ ID NO: 47857 - protein, 15 aa, Artificial Sequence
  Peptide Derived from Human Papillomavirus
CSEVEAAETQVTVNT

SEQ ID NO: 47858 - protein, 15 aa, Artificial Sequence
  Peptide Derived from Human Papillomavirus
CWTYFDNYMRNALDG

SEQ ID NO: 47859 - protein, 15 aa, Artificial Sequence
  Peptide Derived from Human Papillomavirus
DCKWGVLILALLRYK

SEQ ID NO: 47860 - protein, 15 aa, Artificial Sequence
  Peptide Derived from Human Papillomavirus
DMAFQYAQLADCNSN

SEQ ID NO: 47861 - protein, 15 aa, Artificial Sequence
  Peptide Derived from Human Papillomavirus
DNKWPYLESRVTVFT

SEQ ID NO: 47862 - protein, 15 aa, Artificial Sequence
  Peptide Derived from Human Papillomavirus
DSGYGCSEVEAAETQ

SEQ ID NO: 47863 - protein, 15 aa, Artificial Sequence
  Peptide Derived from Human Papillomavirus
DSNFDLSDMVQWAFD

SEQ ID NO: 47864 - protein, 15 aa, Artificial Sequence
  Peptide Derived from Human Papillomavirus
DWVMAIFGVNPTVAE

SEQ ID NO: 47865 - protein, 15 aa, Artificial Sequence
  Peptide Derived from Human Papillomavirus
ERTWSRLDLHEDDED

SEQ ID NO: 47866 - protein, 15 aa, Artificial Sequence
  Peptide Derived from Human Papillomavirus
ESDMAFQYAQLADCN

SEQ ID NO: 47867 - protein, 15 aa, Artificial Sequence
  Peptide Derived from Human Papillomavirus
ETCMLIEPPKLRSSV

SEQ ID NO: 47868 - protein, 15 aa, Artificial Sequence
  Peptide Derived from Human Papillomavirus
FDNYMRNALDGNPIS

SEQ ID NO: 47869 - protein, 15 aa, Artificial Sequence
  Peptide Derived from Human Papillomavirus
FIHFLQGAIISFVNS

SEQ ID NO: 47870 - protein, 12 aa, Artificial Sequence
  Peptide Derived from Human Papillomavirus
FKCVTGQNTRPL

SEQ ID NO: 47871 - protein, 15 aa, Artificial Sequence
  Peptide Derived from Human Papillomavirus
FKTLIKPATLYAHIQ

SEQ ID NO: 47872 - protein, 15 aa, Artificial Sequence
  Peptide Derived from Human Papillomavirus
GAIISFVNSNSHFWL

SEQ ID NO: 47873 - protein, 15 aa, Artificial Sequence
  Peptide Derived from Human Papillomavirus
GGSVHSTQSSGGDSS

SEQ ID NO: 47874 - protein, 15 aa, Artificial Sequence
  Peptide Derived from Human Papillomavirus
GIPFGTFKCVTGQNT

SEQ ID NO: 47875 - protein, 15 aa, Artificial Sequence
  Peptide Derived from Human Papillomavirus
GWFFVETIVEKKTGD

SEQ ID NO: 47876 - protein, 15 aa, Artificial Sequence
  Peptide Derived from Human Papillomavirus
HKPLLQLKCPPILLT

SEQ ID NO: 47877 - protein, 15 aa, Artificial Sequence
  Peptide Derived from Human Papillomavirus
IFGVNPTVAEGFKTL

SEQ ID NO: 47878 - protein, 15 aa, Artificial Sequence
  Peptide Derived from Human Papillomavirus
IHFLQGAIISFVNSN

SEQ ID NO: 47879 - protein, 15 aa, Artificial Sequence
  Peptide Derived from Human Papillomavirus
IISFVNSNSHFWLEP

SEQ ID NO: 47880 - protein, 15 aa, Artificial Sequence
  Peptide Derived from Human Papillomavirus
ILALLRYKCGKNRLT

SEQ ID NO: 47881 - protein, 15 aa, Artificial Sequence
  Peptide Derived from Human Papillomavirus
ILLYGPANTGKSYFG

SEQ ID NO: 47882 - protein, 15 aa, Artificial Sequence
  Peptide Derived from Human Papillomavirus
ISEVSGDTPEWIQRL

SEQ ID NO: 47883 - protein, 15 aa, Artificial Sequence
  Peptide Derived from Human Papillomavirus
IYGLSFTDLVRNFKS

SEQ ID NO: 47884 - protein, 15 aa, Artificial Sequence
  Peptide Derived from Human Papillomavirus
KCFFERTWSRLDLHE

SEQ ID NO: 47885 - protein, 15 aa, Artificial Sequence
  Peptide Derived from Human Papillomavirus
KDIYGLSFTDLVRNF

SEQ ID NO: 47886 - protein, 15 aa, Artificial Sequence
  Peptide Derived from Human Papillomavirus
KNCILLYGPANTGKS

SEQ ID NO: 47887 - protein, 15 aa, Artificial Sequence
  Peptide Derived from Human Papillomavirus
KPLLQLKCPPILLTS

SEQ ID NO: 47888 - protein, 15 aa, Artificial Sequence
  Peptide Derived from Human Papillomavirus
KSYFGMSFIHFLQGA

SEQ ID NO: 47889 - protein, 15 aa, Artificial Sequence
  Peptide Derived from Human Papillomavirus
KTLIKPATLYAHIQC

SEQ ID NO: 47890 - protein, 15 aa, Artificial Sequence
  Peptide Derived from Human Papillomavirus
KVAMLDDATHTCWTY

SEQ ID NO: 47891 - protein, 15 aa, Artificial Sequence
  Peptide Derived from Human Papillomavirus
KWGVLILALLRYKCG

SEQ ID NO: 47892 - protein, 15 aa, Artificial Sequence
  Peptide Derived from Human Papillomavirus
KWPYLESRVTVFTFP

SEQ ID NO: 47893 - protein, 15 aa, Artificial Sequence
  Peptide Derived from Human Papillomavirus
LEPLADTKVAMLDDA

SEQ ID NO: 47894 - protein, 15 aa, Artificial Sequence
  Peptide Derived from Human Papillomavirus
LHLLKRKFAGGSKEN

SEQ ID NO: 47895 - protein, 15 aa, Artificial Sequence
  Peptide Derived from Human Papillomavirus
LKEFLKGTPKKNCIL

SEQ ID NO: 47896 - protein, 15 aa, Artificial Sequence
  Peptide Derived from Human Papillomavirus
LLHVPETCMLIEPPK

SEQ ID NO: 47897 - protein, 15 aa, Artificial Sequence
  Peptide Derived from Human Papillomavirus
LLQLKCPPILLTSNI

SEQ ID NO: 47898 - protein, 15 aa, Artificial Sequence
  Peptide Derived from Human Papillomavirus
LYWYRTGISNISEVS

SEQ ID NO: 47899 - protein, 15 aa, Artificial Sequence
  Peptide Derived from Human Papillomavirus
MAIFGVNPTVAEGFK

SEQ ID NO: 47900 - protein, 15 aa, Artificial Sequence
  Peptide Derived from Human Papillomavirus
MSQWIKYRCSKIDEG

SEQ ID NO: 47901 - protein, 15 aa, Artificial Sequence
  Peptide Derived from Human Papillomavirus
MVDFIDTQLSICEQA

SEQ ID NO: 47902 - protein, 15 aa, Artificial Sequence
  Peptide Derived from Human Papillomavirus
NCILLYGPANTGKSY

SEQ ID NO: 47903 - protein, 15 aa, Artificial Sequence
  Peptide Derived from Human Papillomavirus
NGWFFVETIVEKKTG

SEQ ID NO: 47904 - protein, 15 aa, Artificial Sequence
  Peptide Derived from Human Papillomavirus
NSHFWLEPLADTKVA

SEQ ID NO: 47905 - protein, 15 aa, Artificial Sequence
  Peptide Derived from Human Papillomavirus
NSPLGEQLSVDTDLS

SEQ ID NO: 47906 - protein, 15 aa, Artificial Sequence
  Peptide Derived from Human Papillomavirus
PEWIQRLTIIQHGID

SEQ ID NO: 47907 - protein, 15 aa, Artificial Sequence
  Peptide Derived from Human Papillomavirus
PPILLTSNIDPAKDN

SEQ ID NO: 47908 - protein, 15 aa, Artificial Sequence
  Peptide Derived from Human Papillomavirus
PPKLRSSVAALYWYR

SEQ ID NO: 47909 - protein, 15 aa, Artificial Sequence
  Peptide Derived from Human Papillomavirus
QAKYLKDCAVMCRHY

SEQ ID NO: 47910 - protein, 15 aa, Artificial Sequence
  Peptide Derived from Human Papillomavirus
QALFHAQEVQNDAQV

SEQ ID NO: 47911 - protein, 15 aa, Artificial Sequence
  Peptide Derived from Human Papillomavirus
QLSVDTDLSPRLQEI

SEQ ID NO: 47912 - protein, 15 aa, Artificial Sequence
  Peptide Derived from Human Papillomavirus
QWAFDNDLTDESDMA

SEQ ID NO: 47913 - protein, 15 aa, Artificial Sequence
  Peptide Derived from Human Papillomavirus
RLTIIQHGIDDSNFD

SEQ ID NO: 47914 - protein, 15 aa, Artificial Sequence
  Peptide Derived from Human Papillomavirus
RLTVAKGLSTLLHVP

SEQ ID NO: 47915 - protein, 15 aa, Artificial Sequence
  Peptide Derived from Human Papillomavirus
RNALDGNPISIDRKH

SEQ ID NO: 47916 - protein, 15 aa, Artificial Sequence
  Peptide Derived from Human Papillomavirus
RRLFTISDSGYGCSE

SEQ ID NO: 47917 - protein, 15 aa, Artificial Sequence
  Peptide Derived from Human Papillomavirus
SDMVDFIDTQLSICE

SEQ ID NO: 47918 - protein, 15 aa, Artificial Sequence
  Peptide Derived from Human Papillomavirus
SHFWLEPLADTKVAM

SEQ ID NO: 47919 - protein, 15 aa, Artificial Sequence
  Peptide Derived from Human Papillomavirus
SPRLQEISLNSGHKK

SEQ ID NO: 47920 - protein, 15 aa, Artificial Sequence
  Peptide Derived from Human Papillomavirus
SQWIKYRCSKIDEGG

SEQ ID NO: 47921 - protein, 15 aa, Artificial Sequence
  Peptide Derived from Human Papillomavirus
STLLHVPETCMLIEP

SEQ ID NO: 47922 - protein, 15 aa, Artificial Sequence
  Peptide Derived from Human Papillomavirus
TDLVRNFKSDKTTCT

SEQ ID NO: 47923 - protein, 15 aa, Artificial Sequence
  Peptide Derived from Human Papillomavirus
TPEWIQRLTIIQHGI

SEQ ID NO: 47924 - protein, 15 aa, Artificial Sequence
  Peptide Derived from Human Papillomavirus
VAALYWYRTGISNIS

SEQ ID NO: 47925 - protein, 15 aa, Artificial Sequence
  Peptide Derived from Human Papillomavirus
VDFIDTQLSICEQAE

SEQ ID NO: 47926 - protein, 15 aa, Artificial Sequence
  Peptide Derived from Human Papillomavirus
VEFISFLRALKEFLK

SEQ ID NO: 47927 - protein, 15 aa, Artificial Sequence
  Peptide Derived from Human Papillomavirus
VETIVEKKTGDVISD

SEQ ID NO: 47928 - protein, 15 aa, Artificial Sequence
  Peptide Derived from Human Papillomavirus
VFTFPHAFPFDKNGN

SEQ ID NO: 47929 - protein, 15 aa, Artificial Sequence
  Peptide Derived from Human Papillomavirus
VMAIFGVNPTVAEGF

SEQ ID NO: 47930 - protein, 15 aa, Artificial Sequence
  Peptide Derived from Human Papillomavirus
VQFLRYQGVEFISFL

SEQ ID NO: 47931 - protein, 15 aa, Artificial Sequence
  Peptide Derived from Human Papillomavirus
VRNFKSDKTTCTDWV

SEQ ID NO: 47932 - protein, 15 aa, Artificial Sequence
  Peptide Derived from Human Papillomavirus
VTVFTFPHAFPFDKN

SEQ ID NO: 47933 - protein, 15 aa, Artificial Sequence
  Peptide Derived from Human Papillomavirus
WGVLILALLRYKCGK

SEQ ID NO: 47934 - protein, 15 aa, Artificial Sequence
  Peptide Derived from Human Papillomavirus
WIKYRCSKIDEGGDW

SEQ ID NO: 47935 - protein, 15 aa, Artificial Sequence
  Peptide Derived from Human Papillomavirus
WPYLESRVTVFTFPH

SEQ ID NO: 47936 - protein, 15 aa, Artificial Sequence
  Peptide Derived from Human Papillomavirus
YAHIQCLDCKWGVLI

SEQ ID NO: 47937 - protein, 15 aa, Artificial Sequence
  Peptide Derived from Human Papillomavirus
YAQLADCNSNAAAFL

SEQ ID NO: 47938 - protein, 15 aa, Artificial Sequence
  Peptide Derived from Human Papillomavirus
  VARIANT 1, 2, 3: Xaa= Any amino acid
XXXMKMQTPKESLSE

SEQ ID NO: 47939 - protein, 15 aa, Artificial Sequence
  Peptide Derived from Human Papillomavirus
AACVSYWGVYYIKDG

SEQ ID NO: 47940 - protein, 15 aa, Artificial Sequence
  Peptide Derived from Human Papillomavirus
ADHYSEISSTWHWTG

SEQ ID NO: 47941 - protein, 15 aa, Artificial Sequence
  Peptide Derived from Human Papillomavirus
CEELWNTEPSQCFKK

SEQ ID NO: 47942 - protein, 15 aa, Artificial Sequence
  Peptide Derived from Human Papillomavirus
CEKYGNSNTWEVQYG

SEQ ID NO: 47943 - protein, 15 aa, Artificial Sequence
  Peptide Derived from Human Papillomavirus
CMNYVVWDSIYYITE

SEQ ID NO: 47944 - protein, 15 aa, Artificial Sequence
  Peptide Derived from Human Papillomavirus
DDTVSATQIVRQLQH

SEQ ID NO: 47945 - protein, 15 aa, Artificial Sequence
  Peptide Derived from Human Papillomavirus
DSIYYITETGIWDKT

SEQ ID NO: 47946 - protein, 15 aa, Artificial Sequence
  Peptide Derived from Human Papillomavirus
EELWNTEPSQCFKKG

SEQ ID NO: 47947 - protein, 15 aa, Artificial Sequence
  Peptide Derived from Human Papillomavirus
ELQMALKGLAQSKYN

SEQ ID NO: 47948 - protein, 15 aa, Artificial Sequence
  Peptide Derived from Human Papillomavirus
ETGIWDKTAACVSYW

SEQ ID NO: 47949 - protein, 15 aa, Artificial Sequence
  Peptide Derived from Human Papillomavirus
EVQYGGNVIDCNDSM

SEQ ID NO: 47950 - protein, 15 aa, Artificial Sequence
  Peptide Derived from Human Papillomavirus
GNVIDCNDSMCSTSD

SEQ ID NO: 47951 - protein, 15 aa, Artificial Sequence
  Peptide Derived from Human Papillomavirus
HKAIELQMALKGLAQ

SEQ ID NO: 47952 - protein, 15 aa, Artificial Sequence
  Peptide Derived from Human Papillomavirus
HNPLLCSSTSNNKRR

SEQ ID NO: 47953 - protein, 15 aa, Artificial Sequence
  Peptide Derived from Human Papillomavirus
HQVVPPINISKSKAH

SEQ ID NO: 47954 - protein, 15 aa, Artificial Sequence
  Peptide Derived from Human Papillomavirus
ISYWQLIRLENAILF

SEQ ID NO: 47955 - protein, 15 aa, Artificial Sequence
  Peptide Derived from Human Papillomavirus
ITKLNHQVVPPINIS

SEQ ID NO: 47956 - protein, 15 aa, Artificial Sequence
  Peptide Derived from Human Papillomavirus
IYYITETGIWDKTAA

SEQ ID NO: 47957 - protein, 15 aa, Artificial Sequence
  Peptide Derived from Human Papillomavirus
KESLSERLSALQDKI

SEQ ID NO: 47958 - protein, 15 aa, Artificial Sequence
  Peptide Derived from Human Papillomavirus
KPHIQTPATKRPRQC

SEQ ID NO: 47959 - protein, 15 aa, Artificial Sequence
  Peptide Derived from Human Papillomavirus
LDVVTIPNSVQISVG

SEQ ID NO: 47960 - protein, 15 aa, Artificial Sequence
  Peptide Derived from Human Papillomavirus
LIRLENAILFTAREH

SEQ ID NO: 47961 - protein, 15 aa, Artificial Sequence
  Peptide Derived from Human Papillomavirus
LRKYADHYSEISSTW

SEQ ID NO: 47962 - protein, 15 aa, Artificial Sequence
  Peptide Derived from Human Papillomavirus
LSALQDKILDHYEND

SEQ ID NO: 47963 - protein, 15 aa, Artificial Sequence
  Peptide Derived from Human Papillomavirus
MNYVVWDSIYYITET

SEQ ID NO: 47964 - protein, 15 aa, Artificial Sequence
  Peptide Derived from Human Papillomavirus
NEEWTLQDTCEELWN

SEQ ID NO: 47965 - protein, 15 aa, Artificial Sequence
  Peptide Derived from Human Papillomavirus
NPLLCSSTSNNKRRK

SEQ ID NO: 47966 - protein, 15 aa, Artificial Sequence
  Peptide Derived from Human Papillomavirus
NSQISYWQLIRLENA

SEQ ID NO: 47967 - protein, 15 aa, Artificial Sequence
  Peptide Derived from Human Papillomavirus
NTFLDVVTIPNSVQI

SEQ ID NO: 47968 - protein, 15 aa, Artificial Sequence
  Peptide Derived from Human Papillomavirus
NTHVHNPLLCSSTSN

SEQ ID NO: 47969 - protein, 15 aa, Artificial Sequence
  Peptide Derived from Human Papillomavirus
PINISKSKAHKAIEL

SEQ ID NO: 47970 - protein, 15 aa, Artificial Sequence
  Peptide Derived from Human Papillomavirus
RNTFLDVVTIPNSVQ

SEQ ID NO: 47971 - protein, 15 aa, Artificial Sequence
  Peptide Derived from Human Papillomavirus
RRKVCSGNTTPIIHL

SEQ ID NO: 47972 - protein, 15 aa, Artificial Sequence
  Peptide Derived from Human Papillomavirus
SKDINSQISYWQLIR

SEQ ID NO: 47973 - protein, 15 aa, Artificial Sequence
  Peptide Derived from Human Papillomavirus
SSTWHWTGCNKNTGI

SEQ ID NO: 47974 - protein, 15 aa, Artificial Sequence
  Peptide Derived from Human Papillomavirus
TASVGTPKPHIQTPA

SEQ ID NO: 47975 - protein, 15 aa, Artificial Sequence
  Peptide Derived from Human Papillomavirus
TGIWDKTAACVSYWG

SEQ ID NO: 47976 - protein, 15 aa, Artificial Sequence
  Peptide Derived from Human Papillomavirus
TTYYVQFKSECEKYG

SEQ ID NO: 47977 - protein, 15 aa, Artificial Sequence
  Peptide Derived from Human Papillomavirus
VPPINISKSKAHKAI

SEQ ID NO: 47978 - protein, 15 aa, Artificial Sequence
  Peptide Derived from Human Papillomavirus
VRQLQHASTSTPKTA

SEQ ID NO: 47979 - protein, 15 aa, Artificial Sequence
  Peptide Derived from Human Papillomavirus
VSYWGVYYIKDGDTT

SEQ ID NO: 47980 - protein, 15 aa, Artificial Sequence
  Peptide Derived from Human Papillomavirus
VYYIKDGDTTYYVQF

SEQ ID NO: 47981 - protein, 15 aa, Artificial Sequence
  Peptide Derived from Human Papillomavirus
WQLIRLENAILFTAR

SEQ ID NO: 47982 - protein, 15 aa, Artificial Sequence
  Peptide Derived from Human Papillomavirus
ACVYCKATLERTEVY

SEQ ID NO: 47983 - protein, 15 aa, Artificial Sequence
  Peptide Derived from Human Papillomavirus
DLFIVYRDCIAYAAC

SEQ ID NO: 47984 - protein, 15 aa, Artificial Sequence
  Peptide Derived from Human Papillomavirus
DVSIACVYCKATLER

SEQ ID NO: 47985 - protein, 15 aa, Artificial Sequence
  Peptide Derived from Human Papillomavirus
ELRYYSNSVYGETLE

SEQ ID NO: 47986 - protein, 15 aa, Artificial Sequence
  Peptide Derived from Human Papillomavirus
FIVYRDCIAYAACHK

SEQ ID NO: 47987 - protein, 15 aa, Artificial Sequence
  Peptide Derived from Human Papillomavirus
IACVYCKATLERTEV

SEQ ID NO: 47988 - protein, 15 aa, Artificial Sequence
  Peptide Derived from Human Papillomavirus
IRCLRCQKPLNPAEK

SEQ ID NO: 47989 - protein, 15 aa, Artificial Sequence
  Peptide Derived from Human Papillomavirus
KATLERTEVYQFAFK

SEQ ID NO: 47990 - protein, 15 aa, Artificial Sequence
  Peptide Derived from Human Papillomavirus
LEKITNTELYNLLIR

SEQ ID NO: 47991 - protein, 15 aa, Artificial Sequence
  Peptide Derived from Human Papillomavirus
LFIVYRDCIAYAACH

SEQ ID NO: 47992 - protein, 15 aa, Artificial Sequence
  Peptide Derived from Human Papillomavirus
LQDVSIACVYCKATL

SEQ ID NO: 47993 - protein, 15 aa, Artificial Sequence
  Peptide Derived from Human Papillomavirus
LYNLLIRCLRCQKPL

SEQ ID NO: 47994 - protein, 15 aa, Artificial Sequence
  Peptide Derived from Human Papillomavirus
NLLIRCLRCQKPLNP

SEQ ID NO: 47995 - protein, 15 aa, Artificial Sequence
  Peptide Derived from Human Papillomavirus
NTELYNLLIRCLRCQ

SEQ ID NO: 47996 - protein, 15 aa, Artificial Sequence
  Peptide Derived from Human Papillomavirus
NTSLQDVSIACVYCK

SEQ ID NO: 47997 - protein, 15 aa, Artificial Sequence
  Peptide Derived from Human Papillomavirus
PYKLPDLCTELNTSL

SEQ ID NO: 47998 - protein, 15 aa, Artificial Sequence
  Peptide Derived from Human Papillomavirus
QFAFKDLFIVYRDCI

SEQ ID NO: 47999 - protein, 15 aa, Artificial Sequence
  Peptide Derived from Human Papillomavirus
QRPYKLPDLCTELNT

SEQ ID NO: 48000 - protein, 15 aa, Artificial Sequence
  Peptide Derived from Human Papillomavirus
RDCIAYAACHKCIDF

SEQ ID NO: 48001 - protein, 15 aa, Artificial Sequence
  Peptide Derived from Human Papillomavirus
SNSVYGETLEKITNT

SEQ ID NO: 48002 - protein, 15 aa, Artificial Sequence
  Peptide Derived from Human Papillomavirus
VYQFAFKDLFIVYRD

SEQ ID NO: 48003 - protein, 15 aa, Artificial Sequence
  Peptide Derived from Human Papillomavirus
  VARIANT 1, 2, 3: Xaa= Any amino acid
XXXMHGPRATLQEIV

SEQ ID NO: 48004 - protein, 15 aa, Artificial Sequence
  Peptide Derived from Human Papillomavirus
ADGVSHAQLPARRAE

SEQ ID NO: 48005 - protein, 15 aa, Artificial Sequence
  Peptide Derived from Human Papillomavirus
HAQLPARRAEPQRHK

SEQ ID NO: 48006 - protein, 15 aa, Artificial Sequence
  Peptide Derived from Human Papillomavirus
LQQLFLSTLSFVCPW

SEQ ID NO: 48007 - protein, 15 aa, Artificial Sequence
  Peptide Derived from Human Papillomavirus
LRTLQQLFLSTLSFV

SEQ ID NO: 48008 - protein, 12 aa, Artificial Sequence
  Peptide Derived from Human Papillomavirus
LSFVCPWCATNQ

SEQ ID NO: 48009 - protein, 15 aa, Artificial Sequence
  Peptide Derived from Human Papillomavirus
LSTLSFVCPWCATNQ

SEQ ID NO: 48010 - protein, 15 aa, Artificial Sequence
  Peptide Derived from Human Papillomavirus
QEIVLHLEPQNELDP

SEQ ID NO: 48011 - protein, 15 aa, Artificial Sequence
  Peptide Derived from Human Papillomavirus
QNELDPVDLLCYEQL

SEQ ID NO: 48012 - protein, 15 aa, Artificial Sequence
  Peptide Derived from Human Papillomavirus
QQLFLSTLSFVCPWC

SEQ ID NO: 48013 - protein, 15 aa, Artificial Sequence
  Peptide Derived from Human Papillomavirus
RATLQEIVLHLEPQN

SEQ ID NO: 48014 - protein, 15 aa, Artificial Sequence
  Peptide Derived from Human Papillomavirus
RHKILCVCCKCDGRI

SEQ ID NO: 48015 - protein, 15 aa, Artificial Sequence
  Peptide Derived from Human Papillomavirus
RIELTVESSADDLRT

SEQ ID NO: 48016 - protein, 13 aa, Artificial Sequence
  Peptide Derived from Human Papillomavirus
TLSFVCPWCATNQ

SEQ ID NO: 48017 - protein, 15 aa, Artificial Sequence
  Peptide Derived from Human Papillomavirus
VDLLCYEQLSESEEE

SEQ ID NO: 48018 - protein, 15 aa, Artificial Sequence
  Peptide Derived from Human Papillomavirus
  VARIANT 1, 2, 3: Xaa= Any amino acid
XXXMAHNIIYGHGII

SEQ ID NO: 48019 - protein, 15 aa, Artificial Sequence
  Peptide Derived from Human Papillomavirus
AEVMSYIHSMNSSIL

SEQ ID NO: 48020 - protein, 15 aa, Artificial Sequence
  Peptide Derived from Human Papillomavirus
AGVMGDTVPTDLYIK

SEQ ID NO: 48021 - protein, 15 aa, Artificial Sequence
  Peptide Derived from Human Papillomavirus
ATAVITQDVRDNVSV

SEQ ID NO: 48022 - protein, 15 aa, Artificial Sequence
  Peptide Derived from Human Papillomavirus
AYQYRVFRVALPDPN

SEQ ID NO: 48023 - protein, 15 aa, Artificial Sequence
  Peptide Derived from Human Papillomavirus
CPPLELKNTIIEDGD

SEQ ID NO: 48024 - protein, 15 aa, Artificial Sequence
  Peptide Derived from Human Papillomavirus
DDYVSRTSIFYHAGS

SEQ ID NO: 48025 - protein, 15 aa, Artificial Sequence
  Peptide Derived from Human Papillomavirus
DLQFIFQLCTITLTA

SEQ ID NO: 48026 - protein, 15 aa, Artificial Sequence
  Peptide Derived from Human Papillomavirus
DLYIKGTSANMRETP

SEQ ID NO: 48027 - protein, 15 aa, Artificial Sequence
  Peptide Derived from Human Papillomavirus
DSTIYNPETQRLVWA

SEQ ID NO: 48028 - protein, 15 aa, Artificial Sequence
  Peptide Derived from Human Papillomavirus
DSTVYLPPPSVARVV

SEQ ID NO: 48029 - protein, 15 aa, Artificial Sequence
  Peptide Derived from Human Papillomavirus
EVPLDICQSICKYPD

SEQ ID NO: 48030 - protein, 15 aa, Artificial Sequence
  Peptide Derived from Human Papillomavirus
FFCLRREQLFARHFW

SEQ ID NO: 48031 - protein, 15 aa, Artificial Sequence
  Peptide Derived from Human Papillomavirus
FLQMALWRPSDSTVY

SEQ ID NO: 48032 - protein, 15 aa, Artificial Sequence
  Peptide Derived from Human Papillomavirus
FPIFLQMALWRPSDS

SEQ ID NO: 48033 - protein, 15 aa, Artificial Sequence
  Peptide Derived from Human Papillomavirus
FSTLQDTKCEVPLDI

SEQ ID NO: 48034 - protein, 15 aa, Artificial Sequence
  Peptide Derived from Human Papillomavirus
GEHWAKGTLCKPAQL

SEQ ID NO: 48035 - protein, 15 aa, Artificial Sequence
  Peptide Derived from Human Papillomavirus
GIIIFLKNVNVFPIF

SEQ ID NO: 48036 - protein, 15 aa, Artificial Sequence
  Peptide Derived from Human Papillomavirus
GMEIGRGQPLGIGLS

SEQ ID NO: 48037 - protein, 15 aa, Artificial Sequence
  Peptide Derived from Human Papillomavirus
GNPYFRVVPSGAGNK

SEQ ID NO: 48038 - protein, 15 aa, Artificial Sequence
  Peptide Derived from Human Papillomavirus
GQPLGIGLSGHPFYN

SEQ ID NO: 48039 - protein, 15 aa, Artificial Sequence
  Peptide Derived from Human Papillomavirus
GSCVYSPSPSGSITT

SEQ ID NO: 48040 - protein, 15 aa, Artificial Sequence
  Peptide Derived from Human Papillomavirus
HNIIYGHGIIIFLKN

SEQ ID NO: 48041 - protein, 15 aa, Artificial Sequence
  Peptide Derived from Human Papillomavirus
HNQLFVTVVDTTRST

SEQ ID NO: 48042 - protein, 15 aa, Artificial Sequence
  Peptide Derived from Human Papillomavirus
IFQLCTITLTAEVMS

SEQ ID NO: 48043 - protein, 15 aa, Artificial Sequence
  Peptide Derived from Human Papillomavirus
IHSMNSSILENWNFG

SEQ ID NO: 48044 - protein, 15 aa, Artificial Sequence
  Peptide Derived from Human Papillomavirus
IIFLKNVNVFPIFLQ

SEQ ID NO: 48045 - protein, 15 aa, Artificial Sequence
  Peptide Derived from Human Papillomavirus
KCEVPLDICQSICKY

SEQ ID NO: 48046 - protein, 15 aa, Artificial Sequence
  Peptide Derived from Human Papillomavirus
KFGLPDSTIYNPETQ

SEQ ID NO: 48047 - protein, 15 aa, Artificial Sequence
  Peptide Derived from Human Papillomavirus
KLKFWTVDLKEKFSS

SEQ ID NO: 48048 - protein, 15 aa, Artificial Sequence
  Peptide Derived from Human Papillomavirus
KQAVPKVSAYQYRVF

SEQ ID NO: 48049 - protein, 15 aa, Artificial Sequence
  Peptide Derived from Human Papillomavirus
LCILGCVPAIGEHWA

SEQ ID NO: 48050 - protein, 15 aa, Artificial Sequence
  Peptide Derived from Human Papillomavirus
LENWNFGVPPPPTTS

SEQ ID NO: 48051 - protein, 15 aa, Artificial Sequence
  Peptide Derived from Human Papillomavirus
LKNVNVFPIFLQMAL

SEQ ID NO: 48052 - protein, 15 aa, Artificial Sequence
  Peptide Derived from Human Papillomavirus
LQFIFQLCTITLTAE

SEQ ID NO: 48053 - protein, 15 aa, Artificial Sequence
  Peptide Derived from Human Papillomavirus
MALWRPSDSTVYLPP

SEQ ID NO: 48054 - protein, 15 aa, Artificial Sequence
  Peptide Derived from Human Papillomavirus
MSYIHSMNSSILENW

SEQ ID NO: 48055 - protein, 15 aa, Artificial Sequence
  Peptide Derived from Human Papillomavirus
NFGVPPPPTTSLVDT

SEQ ID NO: 48056 - protein, 15 aa, Artificial Sequence
  Peptide Derived from Human Papillomavirus
NIIYGHGIIIFLKNV

SEQ ID NO: 48057 - protein, 15 aa, Artificial Sequence
  Peptide Derived from Human Papillomavirus
NKPYWLHKAQGHNNG

SEQ ID NO: 48058 - protein, 15 aa, Artificial Sequence
  Peptide Derived from Human Papillomavirus
NPYFRVVPSGAGNKQ

SEQ ID NO: 48059 - protein, 15 aa, Artificial Sequence
  Peptide Derived from Human Papillomavirus
NTIIEDGDMVDTGYG

SEQ ID NO: 48060 - protein, 15 aa, Artificial Sequence
  Peptide Derived from Human Papillomavirus
NVNVFPIFLQMALWR

SEQ ID NO: 48061 - protein, 15 aa, Artificial Sequence
  Peptide Derived from Human Papillomavirus
NVSVDYKQTQLCILG

SEQ ID NO: 48062 - protein, 15 aa, Artificial Sequence
  Peptide Derived from Human Papillomavirus
NWNFGVPPPPTTSLV

SEQ ID NO: 48063 - protein, 15 aa, Artificial Sequence
  Peptide Derived from Human Papillomavirus
PAQLQPGDCPPLELK

SEQ ID NO: 48064 - protein, 15 aa, Artificial Sequence
  Peptide Derived from Human Papillomavirus
PLDICQSICKYPDYL

SEQ ID NO: 48065 - protein, 15 aa, Artificial Sequence
  Peptide Derived from Human Papillomavirus
PLELKNTIIEDGDMV

SEQ ID NO: 48066 - protein, 15 aa, Artificial Sequence
  Peptide Derived from Human Papillomavirus
PNKFGLPDSTIYNPE

SEQ ID NO: 48067 - protein, 15 aa, Artificial Sequence
  Peptide Derived from Human Papillomavirus
PTDLYIKGTSANMRE

SEQ ID NO: 48068 - protein, 15 aa, Artificial Sequence
  Peptide Derived from Human Papillomavirus
QAGLRRRPTIGPRKR

SEQ ID NO: 48069 - protein, 15 aa, Artificial Sequence
  Peptide Derived from Human Papillomavirus
QFIFQLCTITLTAEV

SEQ ID NO: 48070 - protein, 15 aa, Artificial Sequence
  Peptide Derived from Human Papillomavirus
QLCILGCVPAIGEHW

SEQ ID NO: 48071 - protein, 15 aa, Artificial Sequence
  Peptide Derived from Human Papillomavirus
QLFVTVVDTTRSTNL

SEQ ID NO: 48072 - protein, 15 aa, Artificial Sequence
  Peptide Derived from Human Papillomavirus
QTQLCILGCVPAIGE

SEQ ID NO: 48073 - protein, 15 aa, Artificial Sequence
  Peptide Derived from Human Papillomavirus
QYPLGRKFLVQAGLR

SEQ ID NO: 48074 - protein, 15 aa, Artificial Sequence
  Peptide Derived from Human Papillomavirus
QYRVFRVALPDPNKF

SEQ ID NO: 48075 - protein, 15 aa, Artificial Sequence
  Peptide Derived from Human Papillomavirus
RAGVMGDTVPTDLYI

SEQ ID NO: 48076 - protein, 15 aa, Artificial Sequence
  Peptide Derived from Human Papillomavirus
RHFWNRAGVMGDTVP

SEQ ID NO: 48077 - protein, 15 aa, Artificial Sequence
  Peptide Derived from Human Papillomavirus
RKFLVQAGLRRRPTI

SEQ ID NO: 48078 - protein, 15 aa, Artificial Sequence
  Peptide Derived from Human Papillomavirus
RLVWACVGMEIGRGQ

SEQ ID NO: 48079 - protein, 15 aa, Artificial Sequence
  Peptide Derived from Human Papillomavirus
SCVYSPSPSGSITTS

SEQ ID NO: 48080 - protein, 15 aa, Artificial Sequence
  Peptide Derived from Human Papillomavirus
SGSITTSDSQLFNKP

SEQ ID NO: 48081 - protein, 15 aa, Artificial Sequence
  Peptide Derived from Human Papillomavirus
SIFYHAGSSRLLTVG

SEQ ID NO: 48082 - protein, 15 aa, Artificial Sequence
  Peptide Derived from Human Papillomavirus
SRHVEEYDLQFIFQL

SEQ ID NO: 48083 - protein, 15 aa, Artificial Sequence
  Peptide Derived from Human Papillomavirus
SRLLTVGNPYFRVVP

SEQ ID NO: 48084 - protein, 15 aa, Artificial Sequence
  Peptide Derived from Human Papillomavirus
SSDLDQYPLGRKFLV

SEQ ID NO: 48085 - protein, 15 aa, Artificial Sequence
  Peptide Derived from Human Papillomavirus
STNLTLCASTQNPVP

SEQ ID NO: 48086 - protein, 15 aa, Artificial Sequence
  Peptide Derived from Human Papillomavirus
STVYLPPPSVARVVN

SEQ ID NO: 48087 - protein, 15 aa, Artificial Sequence
  Peptide Derived from Human Papillomavirus
SVDYKQTQLCILGCV

SEQ ID NO: 48088 - protein, 15 aa, Artificial Sequence
  Peptide Derived from Human Papillomavirus
TDDYVSRTSIFYHAG

SEQ ID NO: 48089 - protein, 15 aa, Artificial Sequence
  Peptide Derived from Human Papillomavirus
TDLYIKGTSANMRET

SEQ ID NO: 48090 - protein, 15 aa, Artificial Sequence
  Peptide Derived from Human Papillomavirus
TITLTAEVMSYIHSM

SEQ ID NO: 48091 - protein, 15 aa, Artificial Sequence
  Peptide Derived from Human Papillomavirus
TQDVRDNVSVDYKQT

SEQ ID NO: 48092 - protein, 15 aa, Artificial Sequence
  Peptide Derived from Human Papillomavirus
TQRLVWACVGMEIGR

SEQ ID NO: 48093 - protein, 15 aa, Artificial Sequence
  Peptide Derived from Human Papillomavirus
TSIFYHAGSSRLLTV

SEQ ID NO: 48094 - protein, 15 aa, Artificial Sequence
  Peptide Derived from Human Papillomavirus
TVDLKEKFSSDLDQY

SEQ ID NO: 48095 - protein, 15 aa, Artificial Sequence
  Peptide Derived from Human Papillomavirus
TVYLPPPSVARVVNT

SEQ ID NO: 48096 - protein, 15 aa, Artificial Sequence
  Peptide Derived from Human Papillomavirus
TYRFVQSVAVTCQKD

SEQ ID NO: 48097 - protein, 15 aa, Artificial Sequence
  Peptide Derived from Human Papillomavirus
VDTYRFVQSVAVTCQ

SEQ ID NO: 48098 - protein, 15 aa, Artificial Sequence
  Peptide Derived from Human Papillomavirus
VEEYDLQFIFQLCTI

SEQ ID NO: 48099 - protein, 15 aa, Artificial Sequence
  Peptide Derived from Human Papillomavirus
VFPIFLQMALWRPSD

SEQ ID NO: 48100 - protein, 15 aa, Artificial Sequence
  Peptide Derived from Human Papillomavirus
VFRVALPDPNKFGLP

SEQ ID NO: 48101 - protein, 15 aa, Artificial Sequence
  Peptide Derived from Human Papillomavirus
VPAIGEHWAKGTLCK

SEQ ID NO: 48102 - protein, 15 aa, Artificial Sequence
  Peptide Derived from Human Papillomavirus
VTVVDTTRSTNLTLC

SEQ ID NO: 48103 - protein, 15 aa, Artificial Sequence
  Peptide Derived from Human Papillomavirus
YDKLKFWTVDLKEKF

SEQ ID NO: 48104 - protein, 15 aa, Artificial Sequence
  Peptide Derived from Human Papillomavirus
YFRVVPSGAGNKQAV

SEQ ID NO: 48105 - protein, 15 aa, Artificial Sequence
  Peptide Derived from Human Papillomavirus
YGAMDFSTLQDTKCE

SEQ ID NO: 48106 - protein, 15 aa, Artificial Sequence
  Peptide Derived from Human Papillomavirus
YNKLDDTESAHAATA

SEQ ID NO: 48107 - protein, 15 aa, Artificial Sequence
  Peptide Derived from Human Papillomavirus
YPDYLQMSADPYGDS

SEQ ID NO: 48108 - protein, 15 aa, Artificial Sequence
  Peptide Derived from Human Papillomavirus
YRFVQSVAVTCQKDT

SEQ ID NO: 48109 - protein, 15 aa, Artificial Sequence
  Peptide Derived from Human Papillomavirus
YRVFRVALPDPNKFG

SEQ ID NO: 48110 - protein, 15 aa, Artificial Sequence
  Peptide Derived from Human Papillomavirus
  VARIANT 1, 2, 3: Xaa= Any amino acid
XXXMVSHRAARRKRA

SEQ ID NO: 48111 - protein, 15 aa, Artificial Sequence
  Peptide Derived from Human Papillomavirus
  VARIANT 1, 2: Xaa= Any amino acid
XXMVSHRAARRKRAS

SEQ ID NO: 48112 - protein, 15 aa, Artificial Sequence
  Peptide Derived from Human Papillomavirus
ADKILQWSSLGIFLG

SEQ ID NO: 48113 - protein, 15 aa, Artificial Sequence
  Peptide Derived from Human Papillomavirus
ASSYSNVTVPLTSAW

SEQ ID NO: 48114 - protein, 15 aa, Artificial Sequence
  Peptide Derived from Human Papillomavirus
DIILPSHTPMWPSTS

SEQ ID NO: 48115 - protein, 15 aa, Artificial Sequence
  Peptide Derived from Human Papillomavirus
DKILQWSSLGIFLGG

SEQ ID NO: 48116 - protein, 15 aa, Artificial Sequence
  Peptide Derived from Human Papillomavirus
DSDLFDVYADFPPPA

SEQ ID NO: 48117 - protein, 15 aa, Artificial Sequence
  Peptide Derived from Human Papillomavirus
DSSVVASGAPVPTFT

SEQ ID NO: 48118 - protein, 15 aa, Artificial Sequence
  Peptide Derived from Human Papillomavirus
DTTLSFEPTSNVPDS

SEQ ID NO: 48119 - protein, 15 aa, Artificial Sequence
  Peptide Derived from Human Papillomavirus
EIELQPLISATNDSD

SEQ ID NO: 48120 - protein, 15 aa, Artificial Sequence
  Peptide Derived from Human Papillomavirus
EIPLQTFASSGSGTE

SEQ ID NO: 48121 - protein, 15 aa, Artificial Sequence
  Peptide Derived from Human Papillomavirus
FDVYADFPPPASTTP

SEQ ID NO: 48122 - protein, 15 aa, Artificial Sequence
  Peptide Derived from Human Papillomavirus
FSRLGQRATMFTRSG

SEQ ID NO: 48123 - protein, 15 aa, Artificial Sequence
  Peptide Derived from Human Papillomavirus
GFEITSSGTTTPAVL

SEQ ID NO: 48124 - protein, 15 aa, Artificial Sequence
  Peptide Derived from Human Papillomavirus
GIFLGGLGIGTGSGS

SEQ ID NO: 48125 - protein, 15 aa, Artificial Sequence
  Peptide Derived from Human Papillomavirus
GNIFVGTPTSGSHGY

SEQ ID NO: 48126 - protein, 15 aa, Artificial Sequence
  Peptide Derived from Human Papillomavirus
GTTLADKILQWSSLG

SEQ ID NO: 48127 - protein, 15 aa, Artificial Sequence
  Peptide Derived from Human Papillomavirus
HTPMWPSTSPTNAST

SEQ ID NO: 48128 - protein, 15 aa, Artificial Sequence
  Peptide Derived from Human Papillomavirus
IEPVGPTDPSIVTLV

SEQ ID NO: 48129 - protein, 15 aa, Artificial Sequence
  Peptide Derived from Human Papillomavirus
IIRLHRPALSSRRGT

SEQ ID NO: 48130 - protein, 15 aa, Artificial Sequence
  Peptide Derived from Human Papillomavirus
ILQWSSLGIFLGGLG

SEQ ID NO: 48131 - protein, 15 aa, Artificial Sequence
  Peptide Derived from Human Papillomavirus
INKVEGTTLADKILQ

SEQ ID NO: 48132 - protein, 15 aa, Artificial Sequence
  Peptide Derived from Human Papillomavirus
IVTLVEDSSVVASGA

SEQ ID NO: 48133 - protein, 15 aa, Artificial Sequence
  Peptide Derived from Human Papillomavirus
KYSLTMPSTAASSYS

SEQ ID NO: 48134 - protein, 15 aa, Artificial Sequence
  Peptide Derived from Human Papillomavirus
LFDVYADFPPPASTT

SEQ ID NO: 48135 - protein, 15 aa, Artificial Sequence
  Peptide Derived from Human Papillomavirus
LQTFASSGSGTEPIS

SEQ ID NO: 48136 - protein, 15 aa, Artificial Sequence
  Peptide Derived from Human Papillomavirus
LWPWYYYFPKKRKRI

SEQ ID NO: 48137 - protein, 15 aa, Artificial Sequence
  Peptide Derived from Human Papillomavirus
MDIIRLHRPALSSRR

SEQ ID NO: 48138 - protein, 15 aa, Artificial Sequence
  Peptide Derived from Human Papillomavirus
NIFVGTPTSGSHGYE

SEQ ID NO: 48139 - protein, 15 aa, Artificial Sequence
  Peptide Derived from Human Papillomavirus
NPAFSDPSIIEVPQT

SEQ ID NO: 48140 - protein, 15 aa, Artificial Sequence
  Peptide Derived from Human Papillomavirus
NPAYEPLDTTLSFEP

SEQ ID NO: 48141 - protein, 15 aa, Artificial Sequence
  Peptide Derived from Human Papillomavirus
NQQVRVSTSQFLTHP

SEQ ID NO: 48142 - protein, 15 aa, Artificial Sequence
  Peptide Derived from Human Papillomavirus
NTVVDVGPTRPPVVI

SEQ ID NO: 48143 - protein, 15 aa, Artificial Sequence
  Peptide Derived from Human Papillomavirus
NVTVPLTSAWDVPIY

SEQ ID NO: 48144 - protein, 15 aa, Artificial Sequence
  Peptide Derived from Human Papillomavirus
PAVLDITPTVDSVSI

SEQ ID NO: 48145 - protein, 15 aa, Artificial Sequence
  Peptide Derived from Human Papillomavirus
PDIILPSHTPMWPST

SEQ ID NO: 48146 - protein, 15 aa, Artificial Sequence
  Peptide Derived from Human Papillomavirus
PSIIEVPQTGEVSGN

SEQ ID NO: 48147 - protein, 15 aa, Artificial Sequence
  Peptide Derived from Human Papillomavirus
PSTIHKSFTYPKYSL

SEQ ID NO: 48148 - protein, 15 aa, Artificial Sequence
  Peptide Derived from Human Papillomavirus
PVVIEPVGPTDPSIV

SEQ ID NO: 48149 - protein, 15 aa, Artificial Sequence
  Peptide Derived from Human Papillomavirus
RGTVRFSRLGQRATM

SEQ ID NO: 48150 - protein, 15 aa, Artificial Sequence
  Peptide Derived from Human Papillomavirus
RKRIPYFFADGFVAA

SEQ ID NO: 48151 - protein, 15 aa, Artificial Sequence
  Peptide Derived from Human Papillomavirus
RPPVVIEPVGPTDPS

SEQ ID NO: 48152 - protein, 15 aa, Artificial Sequence
  Peptide Derived from Human Papillomavirus
RVHFYHDISPIAATE

SEQ ID NO: 48153 - protein, 15 aa, Artificial Sequence
  Peptide Derived from Human Papillomavirus
SDFMDIIRLHRPALS

SEQ ID NO: 48154 - protein, 15 aa, Artificial Sequence
  Peptide Derived from Human Papillomavirus
SFTYPKYSLTMPSTA

SEQ ID NO: 48155 - protein, 15 aa, Artificial Sequence
  Peptide Derived from Human Papillomavirus
SGNIFVGTPTSGSHG

SEQ ID NO: 48156 - protein, 15 aa, Artificial Sequence
  Peptide Derived from Human Papillomavirus
SHGYEEIPLQTFASS

SEQ ID NO: 48157 - protein, 15 aa, Artificial Sequence
  Peptide Derived from Human Papillomavirus
SLGIFLGGLGIGTGS

SEQ ID NO: 48158 - protein, 15 aa, Artificial Sequence
  Peptide Derived from Human Papillomavirus
SLTMPSTAASSYSNV

SEQ ID NO: 48159 - protein, 15 aa, Artificial Sequence
  Peptide Derived from Human Papillomavirus
SNTVVDVGPTRPPVV

SEQ ID NO: 48160 - protein, 15 aa, Artificial Sequence
  Peptide Derived from Human Papillomavirus
SQFLTHPSSLVTFDN

SEQ ID NO: 48161 - protein, 15 aa, Artificial Sequence
  Peptide Derived from Human Papillomavirus
SSLVTFDNPAYEPLD

SEQ ID NO: 48162 - protein, 15 aa, Artificial Sequence
  Peptide Derived from Human Papillomavirus
SSVVASGAPVPTFTG

SEQ ID NO: 48163 - protein, 15 aa, Artificial Sequence
  Peptide Derived from Human Papillomavirus
TEEIELQPLISATND

SEQ ID NO: 48164 - protein, 15 aa, Artificial Sequence
  Peptide Derived from Human Papillomavirus
TEPISSTPLPTVRRV

SEQ ID NO: 48165 - protein, 15 aa, Artificial Sequence
  Peptide Derived from Human Papillomavirus
TPAVLDITPTVDSVS

SEQ ID NO: 48166 - protein, 15 aa, Artificial Sequence
  Peptide Derived from Human Papillomavirus
TPMWPSTSPTNASTT

SEQ ID NO: 48167 - protein, 15 aa, Artificial Sequence
  Peptide Derived from Human Papillomavirus
TPTVDSVSISSTSFT

SEQ ID NO: 48168 - protein, 15 aa, Artificial Sequence
  Peptide Derived from Human Papillomavirus
TSGFEITSSGTTTPA

SEQ ID NO: 48169 - protein, 15 aa, Artificial Sequence
  Peptide Derived from Human Papillomavirus
TSQFLTHPSSLVTFD

SEQ ID NO: 48170 - protein, 15 aa, Artificial Sequence
  Peptide Derived from Human Papillomavirus
TTYIGIHGTQYYLWP

SEQ ID NO: 48171 - protein, 15 aa, Artificial Sequence
  Peptide Derived from Human Papillomavirus
VDSVSISSTSFTNPA

SEQ ID NO: 48172 - protein, 15 aa, Artificial Sequence
  Peptide Derived from Human Papillomavirus
VHFYHDISPIAATEE

SEQ ID NO: 48173 - protein, 15 aa, Artificial Sequence
  Peptide Derived from Human Papillomavirus
VPIYTGPDIILPSHT

SEQ ID NO: 48174 - protein, 15 aa, Artificial Sequence
  Peptide Derived from Human Papillomavirus
VRRVRGPRLYSRANQ

SEQ ID NO: 48175 - protein, 15 aa, Artificial Sequence
  Peptide Derived from Human Papillomavirus
VTLVEDSSVVASGAP

SEQ ID NO: 48176 - protein, 15 aa, Artificial Sequence
  Peptide Derived from Human Papillomavirus
VVDVGPTRPPVVIEP

SEQ ID NO: 48177 - protein, 15 aa, Artificial Sequence
  Peptide Derived from Human Papillomavirus
YADFPPPASTTPSTI

SEQ ID NO: 48178 - protein, 15 aa, Artificial Sequence
  Peptide Derived from Human Papillomavirus
YEPLDTTLSFEPTSN

SEQ ID NO: 48179 - protein, 15 aa, Artificial Sequence
  Peptide Derived from Human Papillomavirus
YHDISPIAATEEIEL

SEQ ID NO: 48180 - protein, 15 aa, Artificial Sequence
  Peptide Derived from Human Papillomavirus
YPKYSLTMPSTAASS

SEQ ID NO: 48181 - protein, 15 aa, Artificial Sequence
  Peptide Derived from Human Papillomavirus
YSNVTVPLTSAWDVP

SEQ ID NO: 48182 - protein, 15 aa, Artificial Sequence
  Peptide Derived from Human Papillomavirus
  VARIANT 1, 2: Xaa= Any amino acid
XXMVPCLQVCKAKAC

SEQ ID NO: 48183 - protein, 15 aa, Artificial Sequence
  Peptide Derived from Human Papillomavirus
AKKFGCKNIWEVHME

SEQ ID NO: 48184 - protein, 15 aa, Artificial Sequence
  Peptide Derived from Human Papillomavirus
CEELWLTEPKKCFKK

SEQ ID NO: 48185 - protein, 15 aa, Artificial Sequence
  Peptide Derived from Human Papillomavirus
CKNIWEVHMENESIY

SEQ ID NO: 48186 - protein, 15 aa, Artificial Sequence
  Peptide Derived from Human Papillomavirus
CLQVCKAKACSAIEV

SEQ ID NO: 48187 - protein, 15 aa, Artificial Sequence
  Peptide Derived from Human Papillomavirus
CSAIEVQIALESLST

SEQ ID NO: 48188 - protein, 15 aa, Artificial Sequence
  Peptide Derived from Human Papillomavirus
CSGVDYRGIYYVHDG

SEQ ID NO: 48189 - protein, 15 aa, Artificial Sequence
  Peptide Derived from Human Papillomavirus
DCGWQKVCSGVDYRG

SEQ ID NO: 48190 - protein, 15 aa, Artificial Sequence
  Peptide Derived from Human Papillomavirus
ESIYCPDSVSSTCRY

SEQ ID NO: 48191 - protein, 15 aa, Artificial Sequence
  Peptide Derived from Human Papillomavirus
EVHMENESIYCPDSV

SEQ ID NO: 48192 - protein, 15 aa, Artificial Sequence
  Peptide Derived from Human Papillomavirus
EVQIALESLSTTIYN

SEQ ID NO: 48193 - protein, 15 aa, Artificial Sequence
  Peptide Derived from Human Papillomavirus
FQKYKTLFVDVTSTY

SEQ ID NO: 48194 - protein, 15 aa, Artificial Sequence
  Peptide Derived from Human Papillomavirus
HIEVWFDGSKNNCMQ

SEQ ID NO: 48195 - protein, 15 aa, Artificial Sequence
  Peptide Derived from Human Papillomavirus
ITIIYKDETQRNSFL

SEQ ID NO: 48196 - protein, 12 aa, Artificial Sequence
  Peptide Derived from Human Papillomavirus
KIPVVYRLVWDK

SEQ ID NO: 48197 - protein, 15 aa, Artificial Sequence
  Peptide Derived from Human Papillomavirus
KTLFVDVTSTYHWTS

SEQ ID NO: 48198 - protein, 15 aa, Artificial Sequence
  Peptide Derived from Human Papillomavirus
KYIYYNGDCGWQKVC

SEQ ID NO: 48199 - protein, 15 aa, Artificial Sequence
  Peptide Derived from Human Papillomavirus
LSHVKIPVVYRLVWD

SEQ ID NO: 48200 - protein, 15 aa, Artificial Sequence
  Peptide Derived from Human Papillomavirus
MQYVAWKYIYYNGDC

SEQ ID NO: 48201 - protein, 15 aa, Artificial Sequence
  Peptide Derived from Human Papillomavirus
NEEWTLRDTCEELWL

SEQ ID NO: 48202 - protein, 15 aa, Artificial Sequence
  Peptide Derived from Human Papillomavirus
NESIYCPDSVSSTCR

SEQ ID NO: 48203 - protein, 15 aa, Artificial Sequence
  Peptide Derived from Human Papillomavirus
NKNYSIITIIYKDET

SEQ ID NO: 48204 - protein, 15 aa, Artificial Sequence
  Peptide Derived from Human Papillomavirus
NSFLSHVKIPVVYRL

SEQ ID NO: 48205 - protein, 15 aa, Artificial Sequence
  Peptide Derived from Human Papillomavirus
QIALESLSTTIYNNE

SEQ ID NO: 48206 - protein, 15 aa, Artificial Sequence
  Peptide Derived from Human Papillomavirus
RYNVSPVETVNEYNT

SEQ ID NO: 48207 - protein, 15 aa, Artificial Sequence
  Peptide Derived from Human Papillomavirus
RYRFQKYKTLFVDVT

SEQ ID NO: 48208 - protein, 15 aa, Artificial Sequence
  Peptide Derived from Human Papillomavirus
STSVGNQDAAVSHRP

SEQ ID NO: 48209 - protein, 15 aa, Artificial Sequence
  Peptide Derived from Human Papillomavirus
TCRYNVSPVETVNEY

SEQ ID NO: 48210 - protein, 15 aa, Artificial Sequence
  Peptide Derived from Human Papillomavirus
TLFVDVTSTYHWTST

SEQ ID NO: 48211 - protein, 15 aa, Artificial Sequence
  Peptide Derived from Human Papillomavirus
TSTYHWTSTDNKNYS

SEQ ID NO: 48212 - protein, 15 aa, Artificial Sequence
  Peptide Derived from Human Papillomavirus
VETVNEYNTHKTTTT

SEQ ID NO: 48213 - protein, 15 aa, Artificial Sequence
  Peptide Derived from Human Papillomavirus
VNEYNTHKTTTTTST

SEQ ID NO: 48214 - protein, 15 aa, Artificial Sequence
  Peptide Derived from Human Papillomavirus
VPCLQVCKAKACSAI

SEQ ID NO: 48215 - protein, 15 aa, Artificial Sequence
  Peptide Derived from Human Papillomavirus
YKTLFVDVTSTYHWT

SEQ ID NO: 48216 - protein, 15 aa, Artificial Sequence
  Peptide Derived from Human Papillomavirus
AEVYNFACTELKLVY

SEQ ID NO: 48217 - protein, 15 aa, Artificial Sequence
  Peptide Derived from Human Papillomavirus
AHGWTGSCLGCWRQT

SEQ ID NO: 48218 - protein, 15 aa, Artificial Sequence
  Peptide Derived from Human Papillomavirus
DFPYAVCRVCLLFYS

SEQ ID NO: 48219 - protein, 15 aa, Artificial Sequence
  Peptide Derived from Human Papillomavirus
DLLIRCYRCQSPLTP

SEQ ID NO: 48220 - protein, 15 aa, Artificial Sequence
  Peptide Derived from Human Papillomavirus
DLRLSCVYCKKELTR

SEQ ID NO: 48221 - protein, 15 aa, Artificial Sequence
  Peptide Derived from Human Papillomavirus
DYSVYGATLESITKK

SEQ ID NO: 48222 - protein, 15 aa, Artificial Sequence
  Peptide Derived from Human Papillomavirus
EIPLIDLRLSCVYCK

SEQ ID NO: 48223 - protein, 15 aa, Artificial Sequence
  Peptide Derived from Human Papillomavirus
FHLIAHGWTGSCLGC

SEQ ID NO: 48224 - protein, 15 aa, Artificial Sequence
  Peptide Derived from Human Papillomavirus
IPLIDLRLSCVYCKK

SEQ ID NO: 48225 - protein, 15 aa, Artificial Sequence
  Peptide Derived from Human Papillomavirus
IRCYRCQSPLTPEEK

SEQ ID NO: 48226 - protein, 15 aa, Artificial Sequence
  Peptide Derived from Human Papillomavirus
KKELTRAEVYNFACT

SEQ ID NO: 48227 - protein, 15 aa, Artificial Sequence
  Peptide Derived from Human Papillomavirus
KKQLCDLLIRCYRCQ

SEQ ID NO: 48228 - protein, 15 aa, Artificial Sequence
  Peptide Derived from Human Papillomavirus
KLVYRDDFPYAVCRV

SEQ ID NO: 48229 - protein, 15 aa, Artificial Sequence
  Peptide Derived from Human Papillomavirus
KYRYYDYSVYGATLE

SEQ ID NO: 48230 - protein, 15 aa, Artificial Sequence
  Peptide Derived from Human Papillomavirus
LESITKKQLCDLLIR

SEQ ID NO: 48231 - protein, 15 aa, Artificial Sequence
  Peptide Derived from Human Papillomavirus
LIDLRLSCVYCKKEL

SEQ ID NO: 48232 - protein, 15 aa, Artificial Sequence
  Peptide Derived from Human Papillomavirus
LSEVLEIPLIDLRLS

SEQ ID NO: 48233 - protein, 15 aa, Artificial Sequence
  Peptide Derived from Human Papillomavirus
PYAVCRVCLLFYSKV

SEQ ID NO: 48234 - protein, 15 aa, Artificial Sequence
  Peptide Derived from Human Papillomavirus
RAEVYNFACTELKLV

SEQ ID NO: 48235 - protein, 15 aa, Artificial Sequence
  Peptide Derived from Human Papillomavirus
RDDFPYAVCRVCLLF

SEQ ID NO: 48236 - protein, 15 aa, Artificial Sequence
  Peptide Derived from Human Papillomavirus
SCVYCKKELTRAEVY

SEQ ID NO: 48237 - protein, 15 aa, Artificial Sequence
  Peptide Derived from Human Papillomavirus
SEVLEIPLIDLRLSC

SEQ ID NO: 48238 - protein, 15 aa, Artificial Sequence
  Peptide Derived from Human Papillomavirus
VCLLFYSKVRKYRYY

SEQ ID NO: 48239 - protein, 15 aa, Artificial Sequence
  Peptide Derived from Human Papillomavirus
VLEIPLIDLRLSCVY

SEQ ID NO: 48240 - protein, 15 aa, Artificial Sequence
  Peptide Derived from Human Papillomavirus
VYNFACTELKLVYRD

SEQ ID NO: 48241 - protein, 15 aa, Artificial Sequence
  Peptide Derived from Human Papillomavirus
YYDYSVYGATLESIT

SEQ ID NO: 48242 - protein, 15 aa, Artificial Sequence
  Peptide Derived from Human Papillomavirus
  VARIANT 1, 2, 3: Xaa= Any amino acid
XXXMHGKVPTLQDVV

SEQ ID NO: 48243 - protein, 13 aa, Artificial Sequence
  Peptide Derived from Human Papillomavirus
ALTVTCPLCASSN

SEQ ID NO: 48244 - protein, 15 aa, Artificial Sequence
  Peptide Derived from Human Papillomavirus
CKFVVQLDIQSTKED

SEQ ID NO: 48245 - protein, 15 aa, Artificial Sequence
  Peptide Derived from Human Papillomavirus
CYLIHVPCCECKFVV

SEQ ID NO: 48246 - protein, 15 aa, Artificial Sequence
  Peptide Derived from Human Papillomavirus
DLRVVQQLLMGALTV

SEQ ID NO: 48247 - protein, 15 aa, Artificial Sequence
  Peptide Derived from Human Papillomavirus
HTCYLIHVPCCECKF

SEQ ID NO: 48248 - protein, 15 aa, Artificial Sequence
  Peptide Derived from Human Papillomavirus
LIHVPCCECKFVVQL

SEQ ID NO: 48249 - protein, 15 aa, Artificial Sequence
  Peptide Derived from Human Papillomavirus
LQDVVLELTPQTEID

SEQ ID NO: 48250 - protein, 15 aa, Artificial Sequence
  Peptide Derived from Human Papillomavirus
LRVVQQLLMGALTVT

SEQ ID NO: 48251 - protein, 15 aa, Artificial Sequence
  Peptide Derived from Human Papillomavirus
MGALTVTCPLCASSN

SEQ ID NO: 48252 - protein, 15 aa, Artificial Sequence
  Peptide Derived from Human Papillomavirus
QDVVLELTPQTEIDL

SEQ ID NO: 48253 - protein, 15 aa, Artificial Sequence
  Peptide Derived from Human Papillomavirus
QLLMGALTVTCPLCA

SEQ ID NO: 48254 - protein, 15 aa, Artificial Sequence
  Peptide Derived from Human Papillomavirus
QQLLMGALTVTCPLC

SEQ ID NO: 48255 - protein, 15 aa, Artificial Sequence
  Peptide Derived from Human Papillomavirus
TCYLIHVPCCECKFV

SEQ ID NO: 48256 - protein, 15 aa, Artificial Sequence
  Peptide Derived from Human Papillomavirus
VPTLQDVVLELTPQT

SEQ ID NO: 48257 - protein, 15 aa, Artificial Sequence
  Peptide Derived from Human Papillomavirus
VQQLLMGALTVTCPL

SEQ ID NO: 48258 - protein, 15 aa, Artificial Sequence
  Peptide Derived from Human Papillomavirus
VVQLDIQSTKEDLRV

SEQ ID NO: 48259 - protein, 15 aa, Artificial Sequence
  Peptide Derived from Human Papillomavirus
  VARIANT 1, 2, 3: Xaa= Any amino acid
XXXMMLPMMYIYRDP

SEQ ID NO: 48260 - protein, 15 aa, Artificial Sequence
  Peptide Derived from Human Papillomavirus
  VARIANT 1: Xaa= Any amino acid
XMMLPMMYIYRDPPL

SEQ ID NO: 48261 - protein, 15 aa, Artificial Sequence
  Peptide Derived from Human Papillomavirus
AGKVGETIPAELYLK

SEQ ID NO: 48262 - protein, 15 aa, Artificial Sequence
  Peptide Derived from Human Papillomavirus
ANLLEDWNIGLSPPV

SEQ ID NO: 48263 - protein, 15 aa, Artificial Sequence
  Peptide Derived from Human Papillomavirus
AVNVFPIFLQMATWR

SEQ ID NO: 48264 - protein, 15 aa, Artificial Sequence
  Peptide Derived from Human Papillomavirus
AYQYRVFRVRLPDPN

SEQ ID NO: 48265 - protein, 15 aa, Artificial Sequence
  Peptide Derived from Human Papillomavirus
CIFLDVGAVNVFPIF

SEQ ID NO: 48266 - protein, 15 aa, Artificial Sequence
  Peptide Derived from Human Papillomavirus
CPPLALINTPIEDGD

SEQ ID NO: 48267 - protein, 15 aa, Artificial Sequence
  Peptide Derived from Human Papillomavirus
DPPLHYGLCIFLDVG

SEQ ID NO: 48268 - protein, 15 aa, Artificial Sequence
  Peptide Derived from Human Papillomavirus
DSYVKRTSIFYHAGS

SEQ ID NO: 48269 - protein, 15 aa, Artificial Sequence
  Peptide Derived from Human Papillomavirus
DVNLQDSFSTDLDQF

SEQ ID NO: 48270 - protein, 15 aa, Artificial Sequence
  Peptide Derived from Human Papillomavirus
DWNIGLSPPVATSLE

SEQ ID NO: 48271 - protein, 15 aa, Artificial Sequence
  Peptide Derived from Human Papillomavirus
EDKYRYVRSTAITCQ

SEQ ID NO: 48272 - protein, 15 aa, Artificial Sequence
  Peptide Derived from Human Papillomavirus
ELQFVFQLCKITLSA

SEQ ID NO: 48273 - protein, 15 aa, Artificial Sequence
  Peptide Derived from Human Papillomavirus
ENKVYLPPTPVSKVV

SEQ ID NO: 48274 - protein, 15 aa, Artificial Sequence
  Peptide Derived from Human Papillomavirus
EVPLDIVQSTCKYPD

SEQ ID NO: 48275 - protein, 15 aa, Artificial Sequence
  Peptide Derived from Human Papillomavirus
FGAMDFKVLQESKAE

SEQ ID NO: 48276 - protein, 15 aa, Artificial Sequence
  Peptide Derived from Human Papillomavirus
FKVLQESKAEVPLDI

SEQ ID NO: 48277 - protein, 15 aa, Artificial Sequence
  Peptide Derived from Human Papillomavirus
FLDVGAVNVFPIFLQ

SEQ ID NO: 48278 - protein, 15 aa, Artificial Sequence
  Peptide Derived from Human Papillomavirus
FLQMATWRPSENKVY

SEQ ID NO: 48279 - protein, 15 aa, Artificial Sequence
  Peptide Derived from Human Papillomavirus
FNRLDDTESSNLANN

SEQ ID NO: 48280 - protein, 15 aa, Artificial Sequence
  Peptide Derived from Human Papillomavirus
FPIFLQMATWRPSEN

SEQ ID NO: 48281 - protein, 15 aa, Artificial Sequence
  Peptide Derived from Human Papillomavirus
FWDVNLQDSFSTDLD

SEQ ID NO: 48282 - protein, 15 aa, Artificial Sequence
  Peptide Derived from Human Papillomavirus
GAGLSGHPLFNRLDD

SEQ ID NO: 48283 - protein, 15 aa, Artificial Sequence
  Peptide Derived from Human Papillomavirus
GEHWTKGAVCKSTQV

SEQ ID NO: 48284 - protein, 15 aa, Artificial Sequence
  Peptide Derived from Human Papillomavirus
GLEVGRGQPLGAGLS

SEQ ID NO: 48285 - protein, 15 aa, Artificial Sequence
  Peptide Derived from Human Papillomavirus
GNQLFVTVVDTTRST

SEQ ID NO: 48286 - protein, 15 aa, Artificial Sequence
  Peptide Derived from Human Papillomavirus
GQPLGAGLSGHPLFN

SEQ ID NO: 48287 - protein, 15 aa, Artificial Sequence
  Peptide Derived from Human Papillomavirus
KAEVPLDIVQSTCKY

SEQ ID NO: 48288 - protein, 15 aa, Artificial Sequence
  Peptide Derived from Human Papillomavirus
KFGLPDTNIYNPDQE

SEQ ID NO: 48289 - protein, 15 aa, Artificial Sequence
  Peptide Derived from Human Papillomavirus
KITLSAEVMAYLHNM

SEQ ID NO: 48290 - protein, 15 aa, Artificial Sequence
  Peptide Derived from Human Papillomavirus
KTNIPKVSAYQYRVF

SEQ ID NO: 48291 - protein, 15 aa, Artificial Sequence
  Peptide Derived from Human Papillomavirus
KVYLPPTPVSKVVAT

SEQ ID NO: 48292 - protein, 15 aa, Artificial Sequence
  Peptide Derived from Human Papillomavirus
KYKFWDVNLQDSFST

SEQ ID NO: 48293 - protein, 15 aa, Artificial Sequence
  Peptide Derived from Human Papillomavirus
KYRYVRSTAITCQRE

SEQ ID NO: 48294 - protein, 15 aa, Artificial Sequence
  Peptide Derived from Human Papillomavirus
LAKYKFWDVNLQDSF

SEQ ID NO: 48295 - protein, 15 aa, Artificial Sequence
  Peptide Derived from Human Papillomavirus
LCIFLDVGAVNVFPI

SEQ ID NO: 48296 - protein, 15 aa, Artificial Sequence
  Peptide Derived from Human Papillomavirus
LCIVGCTPAMGEHWT

SEQ ID NO: 48297 - protein, 15 aa, Artificial Sequence
  Peptide Derived from Human Papillomavirus
LEDWNIGLSPPVATS

SEQ ID NO: 48298 - protein, 15 aa, Artificial Sequence
  Peptide Derived from Human Papillomavirus
LHNMNANLLEDWNIG

SEQ ID NO: 48299 - protein, 15 aa, Artificial Sequence
  Peptide Derived from Human Papillomavirus
LRHVEEYELQFVFQL

SEQ ID NO: 48300 - protein, 15 aa, Artificial Sequence
  Peptide Derived from Human Papillomavirus
LSKYDARKINQYLRH

SEQ ID NO: 48301 - protein, 15 aa, Artificial Sequence
  Peptide Derived from Human Papillomavirus
MAYLHNMNANLLEDW

SEQ ID NO: 48302 - protein, 15 aa, Artificial Sequence
  Peptide Derived from Human Papillomavirus
MMYIYRDPPLHYGLC

SEQ ID NO: 48303 - protein, 15 aa, Artificial Sequence
  Peptide Derived from Human Papillomavirus
MYIYRDPPLHYGLCI

SEQ ID NO: 48304 - protein, 15 aa, Artificial Sequence
  Peptide Derived from Human Papillomavirus
NIGLSPPVATSLEDK

SEQ ID NO: 48305 - protein, 15 aa, Artificial Sequence
  Peptide Derived from Human Papillomavirus
NISVDGKQTQLCIVG

SEQ ID NO: 48306 - protein, 15 aa, Artificial Sequence
  Peptide Derived from Human Papillomavirus
NKPYWLQRAQGHNNG

SEQ ID NO: 48307 - protein, 15 aa, Artificial Sequence
  Peptide Derived from Human Papillomavirus
NKVYLPPTPVSKVVA

SEQ ID NO: 48308 - protein, 15 aa, Artificial Sequence
  Peptide Derived from Human Papillomavirus
NTPIEDGDMIDTGFG

SEQ ID NO: 48309 - protein, 15 aa, Artificial Sequence
  Peptide Derived from Human Papillomavirus
PAELYLKGSNGREPP

SEQ ID NO: 48310 - protein, 15 aa, Artificial Sequence
  Peptide Derived from Human Papillomavirus
PLALINTPIEDGDMI

SEQ ID NO: 48311 - protein, 15 aa, Artificial Sequence
  Peptide Derived from Human Papillomavirus
PLDIVQSTCKYPDYL

SEQ ID NO: 48312 - protein, 15 aa, Artificial Sequence
  Peptide Derived from Human Papillomavirus
PMMYIYRDPPLHYGL

SEQ ID NO: 48313 - protein, 15 aa, Artificial Sequence
  Peptide Derived from Human Papillomavirus
PNKFGLPDTNIYNPD

SEQ ID NO: 48314 - protein, 15 aa, Artificial Sequence
  Peptide Derived from Human Papillomavirus
PSSVYVATPSGSMIT

SEQ ID NO: 48315 - protein, 15 aa, Artificial Sequence
  Peptide Derived from Human Papillomavirus
PTPVSKVVATDSYVK

SEQ ID NO: 48316 - protein, 15 aa, Artificial Sequence
  Peptide Derived from Human Papillomavirus
QERLVWACVGLEVGR

SEQ ID NO: 48317 - protein, 15 aa, Artificial Sequence
  Peptide Derived from Human Papillomavirus
QFPLGRKFLMQLGTR

SEQ ID NO: 48318 - protein, 15 aa, Artificial Sequence
  Peptide Derived from Human Papillomavirus
QFVFQLCKITLSAEV

SEQ ID NO: 48319 - protein, 15 aa, Artificial Sequence
  Peptide Derived from Human Papillomavirus
QLCIVGCTPAMGEHW

SEQ ID NO: 48320 - protein, 15 aa, Artificial Sequence
  Peptide Derived from Human Papillomavirus
QLFVTVVDTTRSTNM

SEQ ID NO: 48321 - protein, 15 aa, Artificial Sequence
  Peptide Derived from Human Papillomavirus
QTQLCIVGCTPAMGE

SEQ ID NO: 48322 - protein, 15 aa, Artificial Sequence
  Peptide Derived from Human Papillomavirus
QYRVFRVRLPDPNKF

SEQ ID NO: 48323 - protein, 15 aa, Artificial Sequence
  Peptide Derived from Human Papillomavirus
RKFLMQLGTRSKPAV

SEQ ID NO: 48324 - protein, 15 aa, Artificial Sequence
  Peptide Derived from Human Papillomavirus
RLVWACVGLEVGRGQ

SEQ ID NO: 48325 - protein, 15 aa, Artificial Sequence
  Peptide Derived from Human Papillomavirus
SGSMITSEAQLFNKP

SEQ ID NO: 48326 - protein, 15 aa, Artificial Sequence
  Peptide Derived from Human Papillomavirus
SIFYHAGSSRLLAVG

SEQ ID NO: 48327 - protein, 15 aa, Artificial Sequence
  Peptide Derived from Human Papillomavirus
SRLLAVGHPYYSVTK

SEQ ID NO: 48328 - protein, 15 aa, Artificial Sequence
  Peptide Derived from Human Papillomavirus
SSNLANNNVIEDSRD

SEQ ID NO: 48329 - protein, 15 aa, Artificial Sequence
  Peptide Derived from Human Papillomavirus
SSVYVATPSGSMITS

SEQ ID NO: 48330 - protein, 15 aa, Artificial Sequence
  Peptide Derived from Human Papillomavirus
STDLDQFPLGRKFLM

SEQ ID NO: 48331 - protein, 15 aa, Artificial Sequence
  Peptide Derived from Human Papillomavirus
STNMTISTATEQLSK

SEQ ID NO: 48332 - protein, 15 aa, Artificial Sequence
  Peptide Derived from Human Papillomavirus
STQVTTGDCPPLALI

SEQ ID NO: 48333 - protein, 15 aa, Artificial Sequence
  Peptide Derived from Human Papillomavirus
TDSYVKRTSIFYHAG

SEQ ID NO: 48334 - protein, 15 aa, Artificial Sequence
  Peptide Derived from Human Papillomavirus
TEQLSKYDARKINQY

SEQ ID NO: 48335 - protein, 15 aa, Artificial Sequence
  Peptide Derived from Human Papillomavirus
TPAMGEHWTKGAVCK

SEQ ID NO: 48336 - protein, 15 aa, Artificial Sequence
  Peptide Derived from Human Papillomavirus
TSIFYHAGSSRLLAV

SEQ ID NO: 48337 - protein, 15 aa, Artificial Sequence
  Peptide Derived from Human Papillomavirus
VEEYELQFVFQLCKI

SEQ ID NO: 48338 - protein, 15 aa, Artificial Sequence
  Peptide Derived from Human Papillomavirus
VFPIFLQMATWRPSE

SEQ ID NO: 48339 - protein, 15 aa, Artificial Sequence
  Peptide Derived from Human Papillomavirus
VFQLCKITLSAEVMA

SEQ ID NO: 48340 - protein, 15 aa, Artificial Sequence
  Peptide Derived from Human Papillomavirus
VFRVRLPDPNKFGLP

SEQ ID NO: 48341 - protein, 15 aa, Artificial Sequence
  Peptide Derived from Human Papillomavirus
VGAVNVFPIFLQMAT

SEQ ID NO: 48342 - protein, 15 aa, Artificial Sequence
  Peptide Derived from Human Papillomavirus
VSKVVATDSYVKRTS

SEQ ID NO: 48343 - protein, 15 aa, Artificial Sequence
  Peptide Derived from Human Papillomavirus
VTVVDTTRSTNMTIS

SEQ ID NO: 48344 - protein, 15 aa, Artificial Sequence
  Peptide Derived from Human Papillomavirus
WFYLRREQLFARHYF

SEQ ID NO: 48345 - protein, 15 aa, Artificial Sequence
  Peptide Derived from Human Papillomavirus
YPDYLKMSADAYGDS

SEQ ID NO: 48346 - protein, 15 aa, Artificial Sequence
  Peptide Derived from Human Papillomavirus
YRVFRVRLPDPNKFG

SEQ ID NO: 48347 - protein, 15 aa, Artificial Sequence
  Peptide Derived from Human Papillomavirus
YRYVRSTAITCQREQ

SEQ ID NO: 48348 - protein, 15 aa, Artificial Sequence
  Peptide Derived from Human Papillomavirus
YYSVTKDNTKTNIPK

SEQ ID NO: 48349 - protein, 15 aa, Artificial Sequence
  Peptide Derived from Human Papillomavirus
  VARIANT 1, 2, 3: Xaa= Any amino acid
XXXMVAHRATRRKRA

SEQ ID NO: 48350 - protein, 15 aa, Artificial Sequence
  Peptide Derived from Human Papillomavirus
  VARIANT 1, 2: Xaa= Any amino acid
XXMVAHRATRRKRAS

SEQ ID NO: 48351 - protein, 15 aa, Artificial Sequence
  Peptide Derived from Human Papillomavirus
ADKILQWGSLFTYFG

SEQ ID NO: 48352 - protein, 15 aa, Artificial Sequence
  Peptide Derived from Human Papillomavirus
AEEIEMQPLLSANNS

SEQ ID NO: 48353 - protein, 15 aa, Artificial Sequence
  Peptide Derived from Human Papillomavirus
APGLSSQSVATPSAH

SEQ ID NO: 48354 - protein, 15 aa, Artificial Sequence
  Peptide Derived from Human Papillomavirus
ATLVSADNPLFEGTD

SEQ ID NO: 48355 - protein, 15 aa, Artificial Sequence
  Peptide Derived from Human Papillomavirus
DIVLPTGPSTWPFVP

SEQ ID NO: 48356 - protein, 15 aa, Artificial Sequence
  Peptide Derived from Human Papillomavirus
DKILQWGSLFTYFGG

SEQ ID NO: 48357 - protein, 15 aa, Artificial Sequence
  Peptide Derived from Human Papillomavirus
DPAFLDRPATLVSAD

SEQ ID NO: 48358 - protein, 15 aa, Artificial Sequence
  Peptide Derived from Human Papillomavirus
DPDFMNIVALHRPAF

SEQ ID NO: 48359 - protein, 15 aa, Artificial Sequence
  Peptide Derived from Human Papillomavirus
DTSLAFSPSGVAPDP

SEQ ID NO: 48360 - protein, 15 aa, Artificial Sequence
  Peptide Derived from Human Papillomavirus
EIEMQPLLSANNSFD

SEQ ID NO: 48361 - protein, 15 aa, Artificial Sequence
  Peptide Derived from Human Papillomavirus
EIPMQTFAVHGSGTE

SEQ ID NO: 48362 - protein, 15 aa, Artificial Sequence
  Peptide Derived from Human Papillomavirus
ESSVIESGAGIPNFT

SEQ ID NO: 48363 - protein, 15 aa, Artificial Sequence
  Peptide Derived from Human Papillomavirus
FDGLYDIYANIDDEA

SEQ ID NO: 48364 - protein, 15 aa, Artificial Sequence
  Peptide Derived from Human Papillomavirus
FQQVKVTDPAFLDRP

SEQ ID NO: 48365 - protein, 15 aa, Artificial Sequence
  Peptide Derived from Human Papillomavirus
FRRIAAPRLYRKAFQ

SEQ ID NO: 48366 - protein, 15 aa, Artificial Sequence
  Peptide Derived from Human Papillomavirus
FSRLGRKATIQTRRG

SEQ ID NO: 48367 - protein, 15 aa, Artificial Sequence
  Peptide Derived from Human Papillomavirus
FTYFGGLGIGTGTGS

SEQ ID NO: 48368 - protein, 15 aa, Artificial Sequence
  Peptide Derived from Human Papillomavirus
GFEITSSSTTTPAVL

SEQ ID NO: 48369 - protein, 15 aa, Artificial Sequence
  Peptide Derived from Human Papillomavirus
GNILISTPTSGIHSY

SEQ ID NO: 48370 - protein, 15 aa, Artificial Sequence
  Peptide Derived from Human Papillomavirus
GSSFALWPVYFFRRR

SEQ ID NO: 48371 - protein, 15 aa, Artificial Sequence
  Peptide Derived from Human Papillomavirus
HDVYIQGSSFALWPV

SEQ ID NO: 48372 - protein, 15 aa, Artificial Sequence
  Peptide Derived from Human Papillomavirus
HLPIKPSTLSFASNT

SEQ ID NO: 48373 - protein, 15 aa, Artificial Sequence
  Peptide Derived from Human Papillomavirus
HYYYDISPIAQAEEI

SEQ ID NO: 48374 - protein, 15 aa, Artificial Sequence
  Peptide Derived from Human Papillomavirus
IHSYEEIPMQTFAVH

SEQ ID NO: 48375 - protein, 15 aa, Artificial Sequence
  Peptide Derived from Human Papillomavirus
ILQWGSLFTYFGGLG

SEQ ID NO: 48376 - protein, 15 aa, Artificial Sequence
  Peptide Derived from Human Papillomavirus
IPGFRRIAAPRLYRK

SEQ ID NO: 48377 - protein, 15 aa, Artificial Sequence
  Peptide Derived from Human Papillomavirus
IVDVTPARPPIVVES

SEQ ID NO: 48378 - protein, 15 aa, Artificial Sequence
  Peptide Derived from Human Papillomavirus
IVTLVEESSVIESGA

SEQ ID NO: 48379 - protein, 15 aa, Artificial Sequence
  Peptide Derived from Human Papillomavirus
MNIVALHRPAFTTRR

SEQ ID NO: 48380 - protein, 15 aa, Artificial Sequence
  Peptide Derived from Human Papillomavirus
MQTFAVHGSGTEPIS

SEQ ID NO: 48381 - protein, 15 aa, Artificial Sequence
  Peptide Derived from Human Papillomavirus
NILISTPTSGIHSYE

SEQ ID NO: 48382 - protein, 15 aa, Artificial Sequence
  Peptide Derived from Human Papillomavirus
NPLFEGTDTSLAFSP

SEQ ID NO: 48383 - protein, 15 aa, Artificial Sequence
  Peptide Derived from Human Papillomavirus
NPLFIDPPVIEAPQT

SEQ ID NO: 48384 - protein, 15 aa, Artificial Sequence
  Peptide Derived from Human Papillomavirus
PAFLDRPATLVSADN

SEQ ID NO: 48385 - protein, 15 aa, Artificial Sequence
  Peptide Derived from Human Papillomavirus
PAVLDITPTSSTVHV

SEQ ID NO: 48386 - protein, 15 aa, Artificial Sequence
  Peptide Derived from Human Papillomavirus
PDFMNIVALHRPAFT

SEQ ID NO: 48387 - protein, 15 aa, Artificial Sequence
  Peptide Derived from Human Papillomavirus
PDIVLPTGPSTWPFV

SEQ ID NO: 48388 - protein, 15 aa, Artificial Sequence
  Peptide Derived from Human Papillomavirus
PIVVESVGPTDPSIV

SEQ ID NO: 48389 - protein, 15 aa, Artificial Sequence
  Peptide Derived from Human Papillomavirus
PLFIDPPVIEAPQTG

SEQ ID NO: 48390 - protein, 15 aa, Artificial Sequence
  Peptide Derived from Human Papillomavirus
PPVIEAPQTGEVSGN

SEQ ID NO: 48391 - protein, 15 aa, Artificial Sequence
  Peptide Derived from Human Papillomavirus
PSTIVDVTPARPPIV

SEQ ID NO: 48392 - protein, 15 aa, Artificial Sequence
  Peptide Derived from Human Papillomavirus
QKTWADKILQWGSLF

SEQ ID NO: 48393 - protein, 15 aa, Artificial Sequence
  Peptide Derived from Human Papillomavirus
QPLLSANNSFDGLYD

SEQ ID NO: 48394 - protein, 15 aa, Artificial Sequence
  Peptide Derived from Human Papillomavirus
RAGYVPLGSRPSTIV

SEQ ID NO: 48395 - protein, 15 aa, Artificial Sequence
  Peptide Derived from Human Papillomavirus
RGGVRFSRLGRKATI

SEQ ID NO: 48396 - protein, 15 aa, Artificial Sequence
  Peptide Derived from Human Papillomavirus
RKAFQQVKVTDPAFL

SEQ ID NO: 48397 - protein, 15 aa, Artificial Sequence
  Peptide Derived from Human Papillomavirus
RKRIPYFFADGDVAA

SEQ ID NO: 48398 - protein, 15 aa, Artificial Sequence
  Peptide Derived from Human Papillomavirus
RPPIVVESVGPTDPS

SEQ ID NO: 48399 - protein, 15 aa, Artificial Sequence
  Peptide Derived from Human Papillomavirus
RVHYYYDISPIAQAE

SEQ ID NO: 48400 - protein, 15 aa, Artificial Sequence
  Peptide Derived from Human Papillomavirus
SAHLPIKPSTLSFAS

SEQ ID NO: 48401 - protein, 15 aa, Artificial Sequence
  Peptide Derived from Human Papillomavirus
SGGFEITSSSTTTPA

SEQ ID NO: 48402 - protein, 15 aa, Artificial Sequence
  Peptide Derived from Human Papillomavirus
SGNILISTPTSGIHS

SEQ ID NO: 48403 - protein, 15 aa, Artificial Sequence
  Peptide Derived from Human Papillomavirus
SLAFSPSGVAPDPDF

SEQ ID NO: 48404 - protein, 15 aa, Artificial Sequence
  Peptide Derived from Human Papillomavirus
SQSVATPSAHLPIKP

SEQ ID NO: 48405 - protein, 15 aa, Artificial Sequence
  Peptide Derived from Human Papillomavirus
SSTVHVSSTHITNPL

SEQ ID NO: 48406 - protein, 15 aa, Artificial Sequence
  Peptide Derived from Human Papillomavirus
STIVDVTPARPPIVV

SEQ ID NO: 48407 - protein, 15 aa, Artificial Sequence
  Peptide Derived from Human Papillomavirus
TCKLSGTCPEDVVNK

SEQ ID NO: 48408 - protein, 15 aa, Artificial Sequence
  Peptide Derived from Human Papillomavirus
TEPISSTPIPGFRRI

SEQ ID NO: 48409 - protein, 15 aa, Artificial Sequence
  Peptide Derived from Human Papillomavirus
TFAVHGSGTEPISST

SEQ ID NO: 48410 - protein, 15 aa, Artificial Sequence
  Peptide Derived from Human Papillomavirus
TGEVSGNILISTPTS

SEQ ID NO: 48411 - protein, 15 aa, Artificial Sequence
  Peptide Derived from Human Papillomavirus
THDVYIQGSSFALWP

SEQ ID NO: 48412 - protein, 15 aa, Artificial Sequence
  Peptide Derived from Human Papillomavirus
TLSFASNTTNVTAPL

SEQ ID NO: 48413 - protein, 15 aa, Artificial Sequence
  Peptide Derived from Human Papillomavirus
TNPLFIDPPVIEAPQ

SEQ ID NO: 48414 - protein, 15 aa, Artificial Sequence
  Peptide Derived from Human Papillomavirus
TPAVLDITPTSSTVH

SEQ ID NO: 48415 - protein, 15 aa, Artificial Sequence
  Peptide Derived from Human Papillomavirus
TPFYSGPDIVLPTGP

SEQ ID NO: 48416 - protein, 15 aa, Artificial Sequence
  Peptide Derived from Human Papillomavirus
TQLYKTCKLSGTCPE

SEQ ID NO: 48417 - protein, 15 aa, Artificial Sequence
  Peptide Derived from Human Papillomavirus
TVHVSSTHITNPLFI

SEQ ID NO: 48418 - protein, 15 aa, Artificial Sequence
  Peptide Derived from Human Papillomavirus
TWPFVPQSPYDVTHD

SEQ ID NO: 48419 - protein, 15 aa, Artificial Sequence
  Peptide Derived from Human Papillomavirus
VESVGPTDPSIVTLV

SEQ ID NO: 48420 - protein, 15 aa, Artificial Sequence
  Peptide Derived from Human Papillomavirus
VHYYYDISPIAQAEE

SEQ ID NO: 48421 - protein, 15 aa, Artificial Sequence
  Peptide Derived from Human Papillomavirus
VLDITPTSSTVHVSS

SEQ ID NO: 48422 - protein, 15 aa, Artificial Sequence
  Peptide Derived from Human Papillomavirus
VTLVEESSVIESGAG

SEQ ID NO: 48423 - protein, 15 aa, Artificial Sequence
  Peptide Derived from Human Papillomavirus
YANIDDEAPGLSSQS

SEQ ID NO: 48424 - protein, 15 aa, Artificial Sequence
  Peptide Derived from Human Papillomavirus
YVPLGSRPSTIVDVT

SEQ ID NO: 48425 - protein, 9 aa, Artificial Sequence
  Peptide Derived from Human Papillomavirus
LYWYKTGIS

SEQ ID NO: 48426 - protein, 9 aa, Artificial Sequence
  Peptide Derived from Human Papillomavirus
WGMVVLLLV

SEQ ID NO: 48427 - protein, 9 aa, Artificial Sequence
  Peptide Derived from Human Papillomavirus
LTPSIADSI

SEQ ID NO: 48428 - protein, 9 aa, Artificial Sequence
  Peptide Derived from Human Papillomavirus
VKDCATMCR

SEQ ID NO: 48429 - protein, 9 aa, Artificial Sequence
  Peptide Derived from Human Papillomavirus
WYKTGISNI

SEQ ID NO: 48430 - protein, 9 aa, Artificial Sequence
  Peptide Derived from Human Papillomavirus
FLKSNSQAK

SEQ ID NO: 48431 - protein, 9 aa, Artificial Sequence
  Peptide Derived from Human Papillomavirus
LHIQSLACS

SEQ ID NO: 48432 - protein, 9 aa, Artificial Sequence
  Peptide Derived from Human Papillomavirus
IEPPKLRST

SEQ ID NO: 48433 - protein, 9 aa, Artificial Sequence
  Peptide Derived from Human Papillomavirus
WFYVEAVVE

SEQ ID NO: 48434 - protein, 9 aa, Artificial Sequence
  Peptide Derived from Human Papillomavirus
YIDDNLRNA

SEQ ID NO: 48435 - protein, 9 aa, Artificial Sequence
  Peptide Derived from Human Papillomavirus
FELSQMVQW

SEQ ID NO: 48436 - protein, 9 aa, Artificial Sequence
  Peptide Derived from Human Papillomavirus
LVSMDVKHR

SEQ ID NO: 48437 - protein, 9 aa, Artificial Sequence
  Peptide Derived from Human Papillomavirus
WKSFFSRTW

SEQ ID NO: 48438 - protein, 9 aa, Artificial Sequence
  Peptide Derived from Human Papillomavirus
IAYKYAQLA

SEQ ID NO: 48439 - protein, 9 aa, Artificial Sequence
  Peptide Derived from Human Papillomavirus
YGNTEVETQ

SEQ ID NO: 48440 - protein, 9 aa, Artificial Sequence
  Peptide Derived from Human Papillomavirus
IAAFGLTPS

SEQ ID NO: 48441 - protein, 9 aa, Artificial Sequence
  Peptide Derived from Human Papillomavirus
YKYAQLADT

SEQ ID NO: 48442 - protein, 9 aa, Artificial Sequence
  Peptide Derived from Human Papillomavirus
LSKLLCVSP

SEQ ID NO: 48443 - protein, 9 aa, Artificial Sequence
  Peptide Derived from Human Papillomavirus
VSGQNTNTL

SEQ ID NO: 48444 - protein, 9 aa, Artificial Sequence
  Peptide Derived from Human Papillomavirus
LPTFKCVSG

SEQ ID NO: 48445 - protein, 9 aa, Artificial Sequence
  Peptide Derived from Human Papillomavirus
LVDFIVNDN

SEQ ID NO: 48446 - protein, 9 aa, Artificial Sequence
  Peptide Derived from Human Papillomavirus
VSERHTICQ

SEQ ID NO: 48447 - protein, 9 aa, Artificial Sequence
  Peptide Derived from Human Papillomavirus
WKQIVMFLR

SEQ ID NO: 48448 - protein, 9 aa, Artificial Sequence
  Peptide Derived from Human Papillomavirus
LFGMSLMKF

SEQ ID NO: 48449 - protein, 9 aa, Artificial Sequence
  Peptide Derived from Human Papillomavirus
ICFVNSKSH

SEQ ID NO: 48450 - protein, 9 aa, Artificial Sequence
  Peptide Derived from Human Papillomavirus
FMSFLTALK

SEQ ID NO: 48451 - protein, 9 aa, Artificial Sequence
  Peptide Derived from Human Papillomavirus
YVEAVVEKK

SEQ ID NO: 48452 - protein, 9 aa, Artificial Sequence
  Peptide Derived from Human Papillomavirus
FTAQEAKQH

SEQ ID NO: 48453 - protein, 9 aa, Artificial Sequence
  Peptide Derived from Human Papillomavirus
LVQLKCPPL

SEQ ID NO: 48454 - protein, 9 aa, Artificial Sequence
  Peptide Derived from Human Papillomavirus
FGLTPSIAD

SEQ ID NO: 48455 - protein, 9 aa, Artificial Sequence
  Peptide Derived from Human Papillomavirus
LLSKLLCVS

SEQ ID NO: 48456 - protein, 9 aa, Artificial Sequence
  Peptide Derived from Human Papillomavirus
LDDATVPCW

SEQ ID NO: 48457 - protein, 9 aa, Artificial Sequence
  Peptide Derived from Human Papillomavirus
LLQQYCLYL

SEQ ID NO: 48458 - protein, 9 aa, Artificial Sequence
  Peptide Derived from Human Papillomavirus
YGAANTGKS

SEQ ID NO: 48459 - protein, 9 aa, Artificial Sequence
  Peptide Derived from Human Papillomavirus
VYGDTPEWI

SEQ ID NO: 48460 - protein, 9 aa, Artificial Sequence
  Peptide Derived from Human Papillomavirus
YGVSFSELV

SEQ ID NO: 48461 - protein, 9 aa, Artificial Sequence
  Peptide Derived from Human Papillomavirus
MLDDATVPC

SEQ ID NO: 48462 - protein, 9 aa, Artificial Sequence
  Peptide Derived from Human Papillomavirus
ILLYGAANT

SEQ ID NO: 48463 - protein, 9 aa, Artificial Sequence
  Peptide Derived from Human Papillomavirus
YLVSPLSDI

SEQ ID NO: 48464 - protein, 9 aa, Artificial Sequence
  Peptide Derived from Human Papillomavirus
FSRTWSRLS

SEQ ID NO: 48465 - protein, 9 aa, Artificial Sequence
  Peptide Derived from Human Papillomavirus
FWLQPLADA

SEQ ID NO: 48466 - protein, 9 aa, Artificial Sequence
  Peptide Derived from Human Papillomavirus
FGMSLMKFL

SEQ ID NO: 48467 - protein, 9 aa, Artificial Sequence
  Peptide Derived from Human Papillomavirus
LQQYCLYLH

SEQ ID NO: 48468 - protein, 9 aa, Artificial Sequence
  Peptide Derived from Human Papillomavirus
FLQGIPKKN

SEQ ID NO: 48469 - protein, 9 aa, Artificial Sequence
  Peptide Derived from Human Papillomavirus
VSPMCMMIE

SEQ ID NO: 48470 - protein, 9 aa, Artificial Sequence
  Peptide Derived from Human Papillomavirus
FLQGSVICF

SEQ ID NO: 48471 - protein, 9 aa, Artificial Sequence
  Peptide Derived from Human Papillomavirus
LKTSNAKAA

SEQ ID NO: 48472 - protein, 9 aa, Artificial Sequence
  Peptide Derived from Human Papillomavirus
IPKKNCILL

SEQ ID NO: 48473 - protein, 9 aa, Artificial Sequence
  Peptide Derived from Human Papillomavirus
LADAKIGML

SEQ ID NO: 48474 - protein, 9 aa, Artificial Sequence
  Peptide Derived from Human Papillomavirus
LLCVSPMCM

SEQ ID NO: 48475 - protein, 9 aa, Artificial Sequence
  Peptide Derived from Human Papillomavirus
LKCPPLLIT

SEQ ID NO: 48476 - protein, 9 aa, Artificial Sequence
  Peptide Derived from Human Papillomavirus
VSFSELVRP

SEQ ID NO: 48477 - protein, 9 aa, Artificial Sequence
  Peptide Derived from Human Papillomavirus
YKTGISNIS

SEQ ID NO: 48478 - protein, 9 aa, Artificial Sequence
  Peptide Derived from Human Papillomavirus
LQGSVICFV

SEQ ID NO: 48479 - protein, 9 aa, Artificial Sequence
  Peptide Derived from Human Papillomavirus
WIKYRCDRV

SEQ ID NO: 48480 - protein, 9 aa, Artificial Sequence
  Peptide Derived from Human Papillomavirus
LLYGAANTG

SEQ ID NO: 48481 - protein, 9 aa, Artificial Sequence
  Peptide Derived from Human Papillomavirus
VDDSEIAYK

SEQ ID NO: 48482 - protein, 9 aa, Artificial Sequence
  Peptide Derived from Human Papillomavirus
LTQAETETA

SEQ ID NO: 48483 - protein, 9 aa, Artificial Sequence
  Peptide Derived from Human Papillomavirus
FYVEAVVEK

SEQ ID NO: 48484 - protein, 9 aa, Artificial Sequence
  Peptide Derived from Human Papillomavirus
VVFTFPNEF

SEQ ID NO: 48485 - protein, 9 aa, Artificial Sequence
  Peptide Derived from Human Papillomavirus
VETQQMLQV

SEQ ID NO: 48486 - protein, 9 aa, Artificial Sequence
  Peptide Derived from Human Papillomavirus
IQRQTVLQH

SEQ ID NO: 48487 - protein, 9 aa, Artificial Sequence
  Peptide Derived from Human Papillomavirus
MMIEPPKLR

SEQ ID NO: 48488 - protein, 9 aa, Artificial Sequence
  Peptide Derived from Human Papillomavirus
LRSTAAALY

SEQ ID NO: 48489 - protein, 9 aa, Artificial Sequence
  Peptide Derived from Human Papillomavirus
LITSNINAG

SEQ ID NO: 48490 - protein, 9 aa, Artificial Sequence
  Peptide Derived from Human Papillomavirus
IVKDCATMC

SEQ ID NO: 48491 - protein, 9 aa, Artificial Sequence
  Peptide Derived from Human Papillomavirus
YDNDIVDDS

SEQ ID NO: 48492 - protein, 9 aa, Artificial Sequence
  Peptide Derived from Human Papillomavirus
IEKLLSKLL

SEQ ID NO: 48493 - protein, 9 aa, Artificial Sequence
  Peptide Derived from Human Papillomavirus
ICQTPLTNI

SEQ ID NO: 48494 - protein, 9 aa, Artificial Sequence
  Peptide Derived from Human Papillomavirus
LVSPLSDIS

SEQ ID NO: 48495 - protein, 9 aa, Artificial Sequence
  Peptide Derived from Human Papillomavirus
LDGNLVSMD

SEQ ID NO: 48496 - protein, 9 aa, Artificial Sequence
  Peptide Derived from Human Papillomavirus
VQLKCPPLL

SEQ ID NO: 48497 - protein, 9 aa, Artificial Sequence
  Peptide Derived from Human Papillomavirus
FESEDSGYG

SEQ ID NO: 48498 - protein, 9 aa, Artificial Sequence
  Peptide Derived from Human Papillomavirus
YLHNRLVVF

SEQ ID NO: 48499 - protein, 9 aa, Artificial Sequence
  Peptide Derived from Human Papillomavirus
VRPFKSNKS

SEQ ID NO: 48500 - protein, 9 aa, Artificial Sequence
  Peptide Derived from Human Papillomavirus
VDNNISPRL

SEQ ID NO: 48501 - protein, 9 aa, Artificial Sequence
  Peptide Derived from Human Papillomavirus
WLQPLADAK

SEQ ID NO: 48502 - protein, 9 aa, Artificial Sequence
  Peptide Derived from Human Papillomavirus
LCVSPMCMM

SEQ ID NO: 48503 - protein, 9 aa, Artificial Sequence
  Peptide Derived from Human Papillomavirus
VKHRPLVQL

SEQ ID NO: 48504 - protein, 9 aa, Artificial Sequence
  Peptide Derived from Human Papillomavirus
LKAICIEKQ

SEQ ID NO: 48505 - protein, 9 aa, Artificial Sequence
  Peptide Derived from Human Papillomavirus
WSRLSLHED

SEQ ID NO: 48506 - protein, 9 aa, Artificial Sequence
  Peptide Derived from Human Papillomavirus
MVVLLLVRY

SEQ ID NO: 48507 - protein, 9 aa, Artificial Sequence
  Peptide Derived from Human Papillomavirus
LNVLKTSNA

SEQ ID NO: 48508 - protein, 9 aa, Artificial Sequence
  Peptide Derived from Human Papillomavirus
WIQRQTVLQ

SEQ ID NO: 48509 - protein, 9 aa, Artificial Sequence
  Peptide Derived from Human Papillomavirus
VVEKKTGDA

SEQ ID NO: 48510 - protein, 9 aa, Artificial Sequence
  Peptide Derived from Human Papillomavirus
MSFLTALKR

SEQ ID NO: 48511 - protein, 9 aa, Artificial Sequence
  Peptide Derived from Human Papillomavirus
FPNEFPFDE

SEQ ID NO: 48512 - protein, 9 aa, Artificial Sequence
  Peptide Derived from Human Papillomavirus
FVNSKSHFW

SEQ ID NO: 48513 - protein, 9 aa, Artificial Sequence
  Peptide Derived from Human Papillomavirus
LVRYKCGKN

SEQ ID NO: 48514 - protein, 9 aa, Artificial Sequence
  Peptide Derived from Human Papillomavirus
LRYQGVEFM

SEQ ID NO: 48515 - protein, 9 aa, Artificial Sequence
  Peptide Derived from Human Papillomavirus
LKRKYLVSP

SEQ ID NO: 48516 - protein, 9 aa, Artificial Sequence
  Peptide Derived from Human Papillomavirus
FKSNKSTCC

SEQ ID NO: 48517 - protein, 9 aa, Artificial Sequence
  Peptide Derived from Human Papillomavirus
VVLLLVRYK

SEQ ID NO: 48518 - protein, 9 aa, Artificial Sequence
  Peptide Derived from Human Papillomavirus
YRCDRVDDG

SEQ ID NO: 48519 - protein, 9 aa, Artificial Sequence
  Peptide Derived from Human Papillomavirus
LHNRLVVFT

SEQ ID NO: 48520 - protein, 9 aa, Artificial Sequence
  Peptide Derived from Human Papillomavirus
LADTNSNAS

SEQ ID NO: 48521 - protein, 9 aa, Artificial Sequence
  Peptide Derived from Human Papillomavirus
YLHIQSLAC

SEQ ID NO: 48522 - protein, 9 aa, Artificial Sequence
  Peptide Derived from Human Papillomavirus
IQSLACSWG

SEQ ID NO: 48523 - protein, 9 aa, Artificial Sequence
  Peptide Derived from Human Papillomavirus
YSKNKVWEV

SEQ ID NO: 48524 - protein, 9 aa, Artificial Sequence
  Peptide Derived from Human Papillomavirus
YKAREMGFK

SEQ ID NO: 48525 - protein, 9 aa, Artificial Sequence
  Peptide Derived from Human Papillomavirus
LTAFNSSHK

SEQ ID NO: 48526 - protein, 9 aa, Artificial Sequence
  Peptide Derived from Human Papillomavirus
MGFKHINHQ

SEQ ID NO: 48527 - protein, 9 aa, Artificial Sequence
  Peptide Derived from Human Papillomavirus
LGTEETQTT

SEQ ID NO: 48528 - protein, 9 aa, Artificial Sequence
  Peptide Derived from Human Papillomavirus
YTAVSSTWH

SEQ ID NO: 48529 - protein, 9 aa, Artificial Sequence
  Peptide Derived from Human Papillomavirus
LSQVKIPKT

SEQ ID NO: 48530 - protein, 9 aa, Artificial Sequence
  Peptide Derived from Human Papillomavirus
LEVYLTAPT

SEQ ID NO: 48531 - protein, 9 aa, Artificial Sequence
  Peptide Derived from Human Papillomavirus
VDYYGLYYV

SEQ ID NO: 48532 - protein, 9 aa, Artificial Sequence
  Peptide Derived from Human Papillomavirus
LTLETIYNS

SEQ ID NO: 48533 - protein, 9 aa, Artificial Sequence
  Peptide Derived from Human Papillomavirus
YNSQYSNEK

SEQ ID NO: 48534 - protein, 9 aa, Artificial Sequence
  Peptide Derived from Human Papillomavirus
FDGDICNTM

SEQ ID NO: 48535 - protein, 9 aa, Artificial Sequence
  Peptide Derived from Human Papillomavirus
INHQVVPTL

SEQ ID NO: 48536 - protein, 9 aa, Artificial Sequence
  Peptide Derived from Human Papillomavirus
VILCPTSVF

SEQ ID NO: 48537 - protein, 9 aa, Artificial Sequence
  Peptide Derived from Human Papillomavirus
VKHKSAIVT

SEQ ID NO: 48538 - protein, 9 aa, Artificial Sequence
  Peptide Derived from Human Papillomavirus
YVHEGIRTY

SEQ ID NO: 48539 - protein, 9 aa, Artificial Sequence
  Peptide Derived from Human Papillomavirus
ILCPTSVFS

SEQ ID NO: 48540 - protein, 9 aa, Artificial Sequence
  Peptide Derived from Human Papillomavirus
LYTAVSSTW

SEQ ID NO: 48541 - protein, 9 aa, Artificial Sequence
  Peptide Derived from Human Papillomavirus
IRTYFVQFK

SEQ ID NO: 48542 - protein, 9 aa, Artificial Sequence
  Peptide Derived from Human Papillomavirus
ICEEASVTV

SEQ ID NO: 48543 - protein, 9 aa, Artificial Sequence
  Peptide Derived from Human Papillomavirus
VPTLAVSKN

SEQ ID NO: 48544 - protein, 9 aa, Artificial Sequence
  Peptide Derived from Human Papillomavirus
WKHMRLECA

SEQ ID NO: 48545 - protein, 9 aa, Artificial Sequence
  Peptide Derived from Human Papillomavirus
VWEVHAGGQ

SEQ ID NO: 48546 - protein, 9 aa, Artificial Sequence
  Peptide Derived from Human Papillomavirus
LQDVSLEVY

SEQ ID NO: 48547 - protein, 9 aa, Artificial Sequence
  Peptide Derived from Human Papillomavirus
YLTAPTGCI

SEQ ID NO: 48548 - protein, 9 aa, Artificial Sequence
  Peptide Derived from Human Papillomavirus
IELQLTLET

SEQ ID NO: 48549 - protein, 9 aa, Artificial Sequence
  Peptide Derived from Human Papillomavirus
VKIPKTITV

SEQ ID NO: 48550 - protein, 9 aa, Artificial Sequence
  Peptide Derived from Human Papillomavirus
YENDSTDLR

SEQ ID NO: 48551 - protein, 9 aa, Artificial Sequence
  Peptide Derived from Human Papillomavirus
WTLQDVSLE

SEQ ID NO: 48552 - protein, 9 aa, Artificial Sequence
  Peptide Derived from Human Papillomavirus
VVPTLAVSK

SEQ ID NO: 48553 - protein, 9 aa, Artificial Sequence
  Peptide Derived from Human Papillomavirus
LQAIELQLT

SEQ ID NO: 48554 - protein, 9 aa, Artificial Sequence
  Peptide Derived from Human Papillomavirus
IRQHLANHP

SEQ ID NO: 48555 - protein, 9 aa, Artificial Sequence
  Peptide Derived from Human Papillomavirus
IQRPRSEPD

SEQ ID NO: 48556 - protein, 9 aa, Artificial Sequence
  Peptide Derived from Human Papillomavirus
LCPTSVFSS

SEQ ID NO: 48557 - protein, 9 aa, Artificial Sequence
  Peptide Derived from Human Papillomavirus
IPKTITVST

SEQ ID NO: 48558 - protein, 9 aa, Artificial Sequence
  Peptide Derived from Human Papillomavirus
VDSAPILTA

SEQ ID NO: 48559 - protein, 9 aa, Artificial Sequence
  Peptide Derived from Human Papillomavirus
VCQDKILTH

SEQ ID NO: 48560 - protein, 9 aa, Artificial Sequence
  Peptide Derived from Human Papillomavirus
LANHPAATH

SEQ ID NO: 48561 - protein, 9 aa, Artificial Sequence
  Peptide Derived from Human Papillomavirus
FKKHCTLYT

SEQ ID NO: 48562 - protein, 9 aa, Artificial Sequence
  Peptide Derived from Human Papillomavirus
VYLTAPTGC

SEQ ID NO: 48563 - protein, 9 aa, Artificial Sequence
  Peptide Derived from Human Papillomavirus
VSSPEIIRQ

SEQ ID NO: 48564 - protein, 9 aa, Artificial Sequence
  Peptide Derived from Human Papillomavirus
IIRQHLANH

SEQ ID NO: 48565 - protein, 9 aa, Artificial Sequence
  Peptide Derived from Human Papillomavirus
VVEGQVDYY

SEQ ID NO: 48566 - protein, 9 aa, Artificial Sequence
  Peptide Derived from Human Papillomavirus
YICEEASVT

SEQ ID NO: 48567 - protein, 9 aa, Artificial Sequence
  Peptide Derived from Human Papillomavirus
LHRDSVDSA

SEQ ID NO: 48568 - protein, 9 aa, Artificial Sequence
  Peptide Derived from Human Papillomavirus
VSKNKALQA

SEQ ID NO: 48569 - protein, 9 aa, Artificial Sequence
  Peptide Derived from Human Papillomavirus
FSSNEVSSP

SEQ ID NO: 48570 - protein, 9 aa, Artificial Sequence
  Peptide Derived from Human Papillomavirus
LLHRDSVDS

SEQ ID NO: 48571 - protein, 9 aa, Artificial Sequence
  Peptide Derived from Human Papillomavirus
WTGHNVKHK

SEQ ID NO: 48572 - protein, 9 aa, Artificial Sequence
  Peptide Derived from Human Papillomavirus
YGLYYVHEG

SEQ ID NO: 48573 - protein, 9 aa, Artificial Sequence
  Peptide Derived from Human Papillomavirus
MRLECAIYY

SEQ ID NO: 48574 - protein, 9 aa, Artificial Sequence
  Peptide Derived from Human Papillomavirus
WTHIYICEE

SEQ ID NO: 48575 - protein, 9 aa, Artificial Sequence
  Peptide Derived from Human Papillomavirus
MTNLDTAST

SEQ ID NO: 48576 - protein, 9 aa, Artificial Sequence
  Peptide Derived from Human Papillomavirus
LLCFCVLLC

SEQ ID NO: 48577 - protein, 9 aa, Artificial Sequence
  Peptide Derived from Human Papillomavirus
FRCFIVYII

SEQ ID NO: 48578 - protein, 9 aa, Artificial Sequence
  Peptide Derived from Human Papillomavirus
VLLCVCLLI

SEQ ID NO: 48579 - protein, 9 aa, Artificial Sequence
  Peptide Derived from Human Papillomavirus
VYIIFVYIP

SEQ ID NO: 48580 - protein, 9 aa, Artificial Sequence
  Peptide Derived from Human Papillomavirus
LCFCVLLCV

SEQ ID NO: 48581 - protein, 9 aa, Artificial Sequence
  Peptide Derived from Human Papillomavirus
IRPLLLSVS

SEQ ID NO: 48582 - protein, 9 aa, Artificial Sequence
  Peptide Derived from Human Papillomavirus
LLIRPLLLS

SEQ ID NO: 48583 - protein, 9 aa, Artificial Sequence
  Peptide Derived from Human Papillomavirus
LCVCLLIRP

SEQ ID NO: 48584 - protein, 9 aa, Artificial Sequence
  Peptide Derived from Human Papillomavirus
LLCVCLLIR

SEQ ID NO: 48585 - protein, 9 aa, Artificial Sequence
  Peptide Derived from Human Papillomavirus
FIVYIIFVY

SEQ ID NO: 48586 - protein, 9 aa, Artificial Sequence
  Peptide Derived from Human Papillomavirus
IPLFLIHTH

SEQ ID NO: 48587 - protein, 9 aa, Artificial Sequence
  Peptide Derived from Human Papillomavirus
YIPLFLIHT

SEQ ID NO: 48588 - protein, 9 aa, Artificial Sequence
  Peptide Derived from Human Papillomavirus
VLLLWITAA

SEQ ID NO: 48589 - protein, 9 aa, Artificial Sequence
  Peptide Derived from Human Papillomavirus
LLLWITAAS

SEQ ID NO: 48590 - protein, 9 aa, Artificial Sequence
  Peptide Derived from Human Papillomavirus
LLLSVSTYT

SEQ ID NO: 48591 - protein, 9 aa, Artificial Sequence
  Peptide Derived from Human Papillomavirus
IIFVYIPLF

SEQ ID NO: 48592 - protein, 9 aa, Artificial Sequence
  Peptide Derived from Human Papillomavirus
FLLCFCVLL

SEQ ID NO: 48593 - protein, 9 aa, Artificial Sequence
  Peptide Derived from Human Papillomavirus
FCVLLCVCL

SEQ ID NO: 48594 - protein, 9 aa, Artificial Sequence
  Peptide Derived from Human Papillomavirus
WITAASAFR

SEQ ID NO: 48595 - protein, 9 aa, Artificial Sequence
  Peptide Derived from Human Papillomavirus
VSTYTSLII

SEQ ID NO: 48596 - protein, 9 aa, Artificial Sequence
  Peptide Derived from Human Papillomavirus
ITAASAFRC

SEQ ID NO: 48597 - protein, 9 aa, Artificial Sequence
  Peptide Derived from Human Papillomavirus
LLWITAASA

SEQ ID NO: 48598 - protein, 9 aa, Artificial Sequence
  Peptide Derived from Human Papillomavirus
LDTASTTLL

SEQ ID NO: 48599 - protein, 9 aa, Artificial Sequence
  Peptide Derived from Human Papillomavirus
LIHTHARFL

SEQ ID NO: 48600 - protein, 9 aa, Artificial Sequence
  Peptide Derived from Human Papillomavirus
LLSVSTYTS

SEQ ID NO: 48601 - protein, 9 aa, Artificial Sequence
  Peptide Derived from Human Papillomavirus
ILVLLLWIT

SEQ ID NO: 48602 - protein, 9 aa, Artificial Sequence
  Peptide Derived from Human Papillomavirus
LLACFLLCF

SEQ ID NO: 48603 - protein, 9 aa, Artificial Sequence
  Peptide Derived from Human Papillomavirus
IILVLLLWI

SEQ ID NO: 48604 - protein, 9 aa, Artificial Sequence
  Peptide Derived from Human Papillomavirus
LACFLLCFC

SEQ ID NO: 48605 - protein, 9 aa, Artificial Sequence
  Peptide Derived from Human Papillomavirus
LIRPLLLSV

SEQ ID NO: 48606 - protein, 9 aa, Artificial Sequence
  Peptide Derived from Human Papillomavirus
LWITAASAF

SEQ ID NO: 48607 - protein, 9 aa, Artificial Sequence
  Peptide Derived from Human Papillomavirus
YTSLIILVL

SEQ ID NO: 48608 - protein, 9 aa, Artificial Sequence
  Peptide Derived from Human Papillomavirus
IFVYIPLFL

SEQ ID NO: 48609 - protein, 9 aa, Artificial Sequence
  Peptide Derived from Human Papillomavirus
FVYIPLFLI

SEQ ID NO: 48610 - protein, 9 aa, Artificial Sequence
  Peptide Derived from Human Papillomavirus
LFLIHTHAR

SEQ ID NO: 48611 - protein, 9 aa, Artificial Sequence
  Peptide Derived from Human Papillomavirus
LIILVLLLW

SEQ ID NO: 48612 - protein, 9 aa, Artificial Sequence
  Peptide Derived from Human Papillomavirus
MHQKRTAMF

SEQ ID NO: 48613 - protein, 9 aa, Artificial Sequence
  Peptide Derived from Human Papillomavirus
YRDGNPYAV

SEQ ID NO: 48614 - protein, 9 aa, Artificial Sequence
  Peptide Derived from Human Papillomavirus
FYSKISEYR

SEQ ID NO: 48615 - protein, 9 aa, Artificial Sequence
  Peptide Derived from Human Papillomavirus
LYGTTLEQQ

SEQ ID NO: 48616 - protein, 9 aa, Artificial Sequence
  Peptide Derived from Human Papillomavirus
FRDLCIVYR

SEQ ID NO: 48617 - protein, 9 aa, Artificial Sequence
  Peptide Derived from Human Papillomavirus
LECVYCKQQ

SEQ ID NO: 48618 - protein, 9 aa, Artificial Sequence
  Peptide Derived from Human Papillomavirus
IRCINCQKP

SEQ ID NO: 48619 - protein, 9 aa, Artificial Sequence
  Peptide Derived from Human Papillomavirus
YCKQQLLRR

SEQ ID NO: 48620 - protein, 9 aa, Artificial Sequence
  Peptide Derived from Human Papillomavirus
YNKPLCDLL

SEQ ID NO: 48621 - protein, 9 aa, Artificial Sequence
  Peptide Derived from Human Papillomavirus
IRGRWTGRC

SEQ ID NO: 48622 - protein, 9 aa, Artificial Sequence
  Peptide Derived from Human Papillomavirus
MSCCRSSRT

SEQ ID NO: 48623 - protein, 9 aa, Artificial Sequence
  Peptide Derived from Human Papillomavirus
YSLYGTTLE

SEQ ID NO: 48624 - protein, 9 aa, Artificial Sequence
  Peptide Derived from Human Papillomavirus
IILECVYCK

SEQ ID NO: 48625 - protein, 9 aa, Artificial Sequence
  Peptide Derived from Human Papillomavirus
INCQKPLCP

SEQ ID NO: 48626 - protein, 9 aa, Artificial Sequence
  Peptide Derived from Human Papillomavirus
LLRREVYDF

SEQ ID NO: 48627 - protein, 9 aa, Artificial Sequence
  Peptide Derived from Human Papillomavirus
LLIRCINCQ

SEQ ID NO: 48628 - protein, 9 aa, Artificial Sequence
  Peptide Derived from Human Papillomavirus
LCDLLIRCI

SEQ ID NO: 48629 - protein, 9 aa, Artificial Sequence
  Peptide Derived from Human Papillomavirus
LPQLCTELQ

SEQ ID NO: 48630 - protein, 9 aa, Artificial Sequence
  Peptide Derived from Human Papillomavirus
VCDKCLKFY

SEQ ID NO: 48631 - protein, 9 aa, Artificial Sequence
  Peptide Derived from Human Papillomavirus
IHDIILECV

SEQ ID NO: 48632 - protein, 9 aa, Artificial Sequence
  Peptide Derived from Human Papillomavirus
WTGRCMSCC

SEQ ID NO: 48633 - protein, 9 aa, Artificial Sequence
  Peptide Derived from Human Papillomavirus
FAFRDLCIV

SEQ ID NO: 48634 - protein, 9 aa, Artificial Sequence
  Peptide Derived from Human Papillomavirus
MHGDTPTLH

SEQ ID NO: 48635 - protein, 9 aa, Artificial Sequence
  Peptide Derived from Human Papillomavirus
MGTLGIVCP

SEQ ID NO: 48636 - protein, 9 aa, Artificial Sequence
  Peptide Derived from Human Papillomavirus
MLDLQPETT

SEQ ID NO: 48637 - protein, 9 aa, Artificial Sequence
  Peptide Derived from Human Papillomavirus
IVTFCCKCD

SEQ ID NO: 48638 - protein, 9 aa, Artificial Sequence
  Peptide Derived from Human Papillomavirus
LEDLLMGTL

SEQ ID NO: 48639 - protein, 9 aa, Artificial Sequence
  Peptide Derived from Human Papillomavirus
LLMGTLGIV

SEQ ID NO: 48640 - protein, 9 aa, Artificial Sequence
  Peptide Derived from Human Papillomavirus
VCPICSQKP

SEQ ID NO: 48641 - protein, 9 aa, Artificial Sequence
  Peptide Derived from Human Papillomavirus
LGIVCPICS

SEQ ID NO: 48642 - protein, 9 aa, Artificial Sequence
  Peptide Derived from Human Papillomavirus
LQPETTDLY

SEQ ID NO: 48643 - protein, 9 aa, Artificial Sequence
  Peptide Derived from Human Papillomavirus
VQSTHVDIR

SEQ ID NO: 48644 - protein, 9 aa, Artificial Sequence
  Peptide Derived from Human Papillomavirus
VDIRTLEDL

SEQ ID NO: 48645 - protein, 9 aa, Artificial Sequence
  Peptide Derived from Human Papillomavirus
YCYEQLNDS

SEQ ID NO: 48646 - protein, 9 aa, Artificial Sequence
  Peptide Derived from Human Papillomavirus
IVCPICSQK

SEQ ID NO: 48647 - protein, 9 aa, Artificial Sequence
  Peptide Derived from Human Papillomavirus
LCVQSTHVD

SEQ ID NO: 48648 - protein, 9 aa, Artificial Sequence
  Peptide Derived from Human Papillomavirus
LHEYMLDLQ

SEQ ID NO: 48649 - protein, 9 aa, Artificial Sequence
  Peptide Derived from Human Papillomavirus
MQVTFIYIL

SEQ ID NO: 48650 - protein, 9 aa, Artificial Sequence
  Peptide Derived from Human Papillomavirus
VTFIYILVI

SEQ ID NO: 48651 - protein, 9 aa, Artificial Sequence
  Peptide Derived from Human Papillomavirus
MTYIHSMNS

SEQ ID NO: 48652 - protein, 9 aa, Artificial Sequence
  Peptide Derived from Human Papillomavirus
VGENVPDDL

SEQ ID NO: 48653 - protein, 9 aa, Artificial Sequence
  Peptide Derived from Human Papillomavirus
FTTLQANKS

SEQ ID NO: 48654 - protein, 9 aa, Artificial Sequence
  Peptide Derived from Human Papillomavirus
YLPPVPVSK

SEQ ID NO: 48655 - protein, 9 aa, Artificial Sequence
  Peptide Derived from Human Papillomavirus
ISTSETTYK

SEQ ID NO: 48656 - protein, 9 aa, Artificial Sequence
  Peptide Derived from Human Papillomavirus
MDYKQTQLC

SEQ ID NO: 48657 - protein, 9 aa, Artificial Sequence
  Peptide Derived from Human Papillomavirus
LELINTVIQ

SEQ ID NO: 48658 - protein, 9 aa, Artificial Sequence
  Peptide Derived from Human Papillomavirus
VARTNIYYH

SEQ ID NO: 48659 - protein, 9 aa, Artificial Sequence
  Peptide Derived from Human Papillomavirus
FIFQLCKIT

SEQ ID NO: 48660 - protein, 9 aa, Artificial Sequence
  Peptide Derived from Human Papillomavirus
IKGSGSTAN

SEQ ID NO: 48661 - protein, 9 aa, Artificial Sequence
  Peptide Derived from Human Papillomavirus
FYNPDTQRL

SEQ ID NO: 48662 - protein, 9 aa, Artificial Sequence
  Peptide Derived from Human Papillomavirus
FGLQPPPGG

SEQ ID NO: 48663 - protein, 9 aa, Artificial Sequence
  Peptide Derived from Human Papillomavirus
VYLPPVPVS

SEQ ID NO: 48664 - protein, 9 aa, Artificial Sequence
  Peptide Derived from Human Papillomavirus
YRFVTSQAI

SEQ ID NO: 48665 - protein, 9 aa, Artificial Sequence
  Peptide Derived from Human Papillomavirus
VNVYHIFFQ

SEQ ID NO: 48666 - protein, 9 aa, Artificial Sequence
  Peptide Derived from Human Papillomavirus
LKEKFSADL

SEQ ID NO: 48667 - protein, 9 aa, Artificial Sequence
  Peptide Derived from Human Papillomavirus
LDICTSICK

SEQ ID NO: 48668 - protein, 9 aa, Artificial Sequence
  Peptide Derived from Human Papillomavirus
MSLWLPSEA

SEQ ID NO: 48669 - protein, 9 aa, Artificial Sequence
  Peptide Derived from Human Papillomavirus
LRREQMFVR

SEQ ID NO: 48670 - protein, 9 aa, Artificial Sequence
  Peptide Derived from Human Papillomavirus
MDFTTLQAN

SEQ ID NO: 48671 - protein, 9 aa, Artificial Sequence
  Peptide Derived from Human Papillomavirus
ILVITCYEN

SEQ ID NO: 48672 - protein, 9 aa, Artificial Sequence
  Peptide Derived from Human Papillomavirus
LQANKSEVP

SEQ ID NO: 48673 - protein, 9 aa, Artificial Sequence
  Peptide Derived from Human Papillomavirus
YDLQFIFQL

SEQ ID NO: 48674 - protein, 9 aa, Artificial Sequence
  Peptide Derived from Human Papillomavirus
WGKGSPCTN

SEQ ID NO: 48675 - protein, 9 aa, Artificial Sequence
  Peptide Derived from Human Papillomavirus
YRVFRIHLP

SEQ ID NO: 48676 - protein, 9 aa, Artificial Sequence
  Peptide Derived from Human Papillomavirus
LFVTVVDTT

SEQ ID NO: 48677 - protein, 9 aa, Artificial Sequence
  Peptide Derived from Human Papillomavirus
LGVGISGHP

SEQ ID NO: 48678 - protein, 9 aa, Artificial Sequence
  Peptide Derived from Human Papillomavirus
VGRGQPLGV

SEQ ID NO: 48679 - protein, 9 aa, Artificial Sequence
  Peptide Derived from Human Papillomavirus
ISGHPLLNK

SEQ ID NO: 48680 - protein, 9 aa, Artificial Sequence
  Peptide Derived from Human Papillomavirus
FPIKKPNNN

SEQ ID NO: 48681 - protein, 9 aa, Artificial Sequence
  Peptide Derived from Human Papillomavirus
LCKITLTAD

SEQ ID NO: 48682 - protein, 9 aa, Artificial Sequence
  Peptide Derived from Human Papillomavirus
MNSTILEDW

SEQ ID NO: 48683 - protein, 9 aa, Artificial Sequence
  Peptide Derived from Human Papillomavirus
LGKRKATPT

SEQ ID NO: 48684 - protein, 9 aa, Artificial Sequence
  Peptide Derived from Human Papillomavirus
LTADVMTYI

SEQ ID NO: 48685 - protein, 9 aa, Artificial Sequence
  Peptide Derived from Human Papillomavirus
VPLDICTSI

SEQ ID NO: 48686 - protein, 9 aa, Artificial Sequence
  Peptide Derived from Human Papillomavirus
FWEVNLKEK

SEQ ID NO: 48687 - protein, 9 aa, Artificial Sequence
  Peptide Derived from Human Papillomavirus
IGCKPPIGE

SEQ ID NO: 48688 - protein, 9 aa, Artificial Sequence
  Peptide Derived from Human Papillomavirus
YTFWEVNLK

SEQ ID NO: 48689 - protein, 9 aa, Artificial Sequence
  Peptide Derived from Human Papillomavirus
VPVSKVVST

SEQ ID NO: 48690 - protein, 9 aa, Artificial Sequence
  Peptide Derived from Human Papillomavirus
WLPSEATVY

SEQ ID NO: 48691 - protein, 9 aa, Artificial Sequence
  Peptide Derived from Human Papillomavirus
IHSMNSTIL

SEQ ID NO: 48692 - protein, 9 aa, Artificial Sequence
  Peptide Derived from Human Papillomavirus
VDNRECISM

SEQ ID NO: 48693 - protein, 9 aa, Artificial Sequence
  Peptide Derived from Human Papillomavirus
YHAGTSRLL

SEQ ID NO: 48694 - protein, 9 aa, Artificial Sequence
  Peptide Derived from Human Papillomavirus
LVPKVSGLQ

SEQ ID NO: 48695 - protein, 9 aa, Artificial Sequence
  Peptide Derived from Human Papillomavirus
YWLQRAQGH

SEQ ID NO: 48696 - protein, 9 aa, Artificial Sequence
  Peptide Derived from Human Papillomavirus
LCAAISTSE

SEQ ID NO: 48697 - protein, 9 aa, Artificial Sequence
  Peptide Derived from Human Papillomavirus
ILVPKVSGL

SEQ ID NO: 48698 - protein, 9 aa, Artificial Sequence
  Peptide Derived from Human Papillomavirus
IQDGDMVDT

SEQ ID NO: 48699 - protein, 9 aa, Artificial Sequence
  Peptide Derived from Human Papillomavirus
VNPGDCPPL

SEQ ID NO: 48700 - protein, 9 aa, Artificial Sequence
  Peptide Derived from Human Papillomavirus
LYIKGSGST

SEQ ID NO: 48701 - protein, 9 aa, Artificial Sequence
  Peptide Derived from Human Papillomavirus
ICTSICKYP

SEQ ID NO: 48702 - protein, 9 aa, Artificial Sequence
  Peptide Derived from Human Papillomavirus
LINTVIQDG

SEQ ID NO: 48703 - protein, 9 aa, Artificial Sequence
  Peptide Derived from Human Papillomavirus
FGFPDTSFY

SEQ ID NO: 48704 - protein, 9 aa, Artificial Sequence
  Peptide Derived from Human Papillomavirus
VSKVVSTDE

SEQ ID NO: 48705 - protein, 9 aa, Artificial Sequence
  Peptide Derived from Human Papillomavirus
FQLCKITLT

SEQ ID NO: 48706 - protein, 9 aa, Artificial Sequence
  Peptide Derived from Human Papillomavirus
LGRKFLLQA

SEQ ID NO: 48707 - protein, 9 aa, Artificial Sequence
  Peptide Derived from Human Papillomavirus
LIGCKPPIG

SEQ ID NO: 48708 - protein, 9 aa, Artificial Sequence
  Peptide Derived from Human Papillomavirus
VTVVDTTRS

SEQ ID NO: 48709 - protein, 9 aa, Artificial Sequence
  Peptide Derived from Human Papillomavirus
LCLIGCKPP

SEQ ID NO: 48710 - protein, 9 aa, Artificial Sequence
  Peptide Derived from Human Papillomavirus
FIYILVITC

SEQ ID NO: 48711 - protein, 9 aa, Artificial Sequence
  Peptide Derived from Human Papillomavirus
VFRIHLPDP

SEQ ID NO: 48712 - protein, 9 aa, Artificial Sequence
  Peptide Derived from Human Papillomavirus
MFVRHLFNR

SEQ ID NO: 48713 - protein, 9 aa, Artificial Sequence
  Peptide Derived from Human Papillomavirus
FNRAGAVGE

SEQ ID NO: 48714 - protein, 9 aa, Artificial Sequence
  Peptide Derived from Human Papillomavirus
LLQAGLKAK

SEQ ID NO: 48715 - protein, 9 aa, Artificial Sequence
  Peptide Derived from Human Papillomavirus
WACVGVEVG

SEQ ID NO: 48716 - protein, 9 aa, Artificial Sequence
  Peptide Derived from Human Papillomavirus
LDQFPLGRK

SEQ ID NO: 48717 - protein, 9 aa, Artificial Sequence
  Peptide Derived from Human Papillomavirus
MVTSDAQIF

SEQ ID NO: 48718 - protein, 9 aa, Artificial Sequence
  Peptide Derived from Human Papillomavirus
LPSEATVYL

SEQ ID NO: 48719 - protein, 9 aa, Artificial Sequence
  Peptide Derived from Human Papillomavirus
YKQTQLCLI

SEQ ID NO: 48720 - protein, 9 aa, Artificial Sequence
  Peptide Derived from Human Papillomavirus
LAVGHPYFP

SEQ ID NO: 48721 - protein, 9 aa, Artificial Sequence
  Peptide Derived from Human Papillomavirus
YFPTPSGSM

SEQ ID NO: 48722 - protein, 9 aa, Artificial Sequence
  Peptide Derived from Human Papillomavirus
MSLCAAIST

SEQ ID NO: 48723 - protein, 9 aa, Artificial Sequence
  Peptide Derived from Human Papillomavirus
YILVITCYE

SEQ ID NO: 48724 - protein, 9 aa, Artificial Sequence
  Peptide Derived from Human Papillomavirus
YYHAGTSRL

SEQ ID NO: 48725 - protein, 9 aa, Artificial Sequence
  Peptide Derived from Human Papillomavirus
LVWACVGVE

SEQ ID NO: 48726 - protein, 9 aa, Artificial Sequence
  Peptide Derived from Human Papillomavirus
LPPVPVSKV

SEQ ID NO: 48727 - protein, 9 aa, Artificial Sequence
  Peptide Derived from Human Papillomavirus
FVTSQAIAC

SEQ ID NO: 48728 - protein, 9 aa, Artificial Sequence
  Peptide Derived from Human Papillomavirus
IHLPDPNKF

SEQ ID NO: 48729 - protein, 9 aa, Artificial Sequence
  Peptide Derived from Human Papillomavirus
IYILVITCY

SEQ ID NO: 48730 - protein, 9 aa, Artificial Sequence
  Peptide Derived from Human Papillomavirus
VDTTRSTNM

SEQ ID NO: 48731 - protein, 9 aa, Artificial Sequence
  Peptide Derived from Human Papillomavirus
IFFQMSLWL

SEQ ID NO: 48732 - protein, 9 aa, Artificial Sequence
  Peptide Derived from Human Papillomavirus
FFQMSLWLP

SEQ ID NO: 48733 - protein, 9 aa, Artificial Sequence
  Peptide Derived from Human Papillomavirus
YIKMVSEPY

SEQ ID NO: 48734 - protein, 9 aa, Artificial Sequence
  Peptide Derived from Human Papillomavirus
VTSQAIACQ

SEQ ID NO: 48735 - protein, 9 aa, Artificial Sequence
  Peptide Derived from Human Papillomavirus
FRIHLPDPN

SEQ ID NO: 48736 - protein, 9 aa, Artificial Sequence
  Peptide Derived from Human Papillomavirus
MRHKRSAKR

SEQ ID NO: 48737 - protein, 9 aa, Artificial Sequence
  Peptide Derived from Human Papillomavirus
FITDTSTTP

SEQ ID NO: 48738 - protein, 9 aa, Artificial Sequence
  Peptide Derived from Human Papillomavirus
ILQYGSMGV

SEQ ID NO: 48739 - protein, 9 aa, Artificial Sequence
  Peptide Derived from Human Papillomavirus
IELQTITPS

SEQ ID NO: 48740 - protein, 9 aa, Artificial Sequence
  Peptide Derived from Human Papillomavirus
FYLHPSYYM

SEQ ID NO: 48741 - protein, 9 aa, Artificial Sequence
  Peptide Derived from Human Papillomavirus
LIPIVPGSP

SEQ ID NO: 48742 - protein, 9 aa, Artificial Sequence
  Peptide Derived from Human Papillomavirus
ITDTSTTPV

SEQ ID NO: 48743 - protein, 9 aa, Artificial Sequence
  Peptide Derived from Human Papillomavirus
FITTPTKLI

SEQ ID NO: 48744 - protein, 9 aa, Artificial Sequence
  Peptide Derived from Human Papillomavirus
FLDIVALHR

SEQ ID NO: 48745 - protein, 9 aa, Artificial Sequence
  Peptide Derived from Human Papillomavirus
VLQPPTPAE

SEQ ID NO: 48746 - protein, 9 aa, Artificial Sequence
  Peptide Derived from Human Papillomavirus
LQYGSMGVF

SEQ ID NO: 48747 - protein, 9 aa, Artificial Sequence
  Peptide Derived from Human Papillomavirus
IVSTNPNTV

SEQ ID NO: 48748 - protein, 9 aa, Artificial Sequence
  Peptide Derived from Human Papillomavirus
LQTITPSTY

SEQ ID NO: 48749 - protein, 9 aa, Artificial Sequence
  Peptide Derived from Human Papillomavirus
MDTFIVSTN

SEQ ID NO: 48750 - protein, 9 aa, Artificial Sequence
  Peptide Derived from Human Papillomavirus
FIDAGAPTS

SEQ ID NO: 48751 - protein, 9 aa, Artificial Sequence
  Peptide Derived from Human Papillomavirus
YNIPLVSGP

SEQ ID NO: 48752 - protein, 9 aa, Artificial Sequence
  Peptide Derived from Human Papillomavirus
FTLSSSTIS

SEQ ID NO: 48753 - protein, 9 aa, Artificial Sequence
  Peptide Derived from Human Papillomavirus
IADQILQYG

SEQ ID NO: 48754 - protein, 9 aa, Artificial Sequence
  Peptide Derived from Human Papillomavirus
IPINITDQA

SEQ ID NO: 48755 - protein, 9 aa, Artificial Sequence
  Peptide Derived from Human Papillomavirus
FGGLGIGTG

SEQ ID NO: 48756 - protein, 9 aa, Artificial Sequence
  Peptide Derived from Human Papillomavirus
LSSSTISTH

SEQ ID NO: 48757 - protein, 9 aa, Artificial Sequence
  Peptide Derived from Human Papillomavirus
YDFSTIDSA

SEQ ID NO: 48758 - protein, 9 aa, Artificial Sequence
  Peptide Derived from Human Papillomavirus
INNTVTTVT

SEQ ID NO: 48759 - protein, 9 aa, Artificial Sequence
  Peptide Derived from Human Papillomavirus
YGSMGVFFG

SEQ ID NO: 48760 - protein, 9 aa, Artificial Sequence
  Peptide Derived from Human Papillomavirus
VEGKTIADQ

SEQ ID NO: 48761 - protein, 9 aa, Artificial Sequence
  Peptide Derived from Human Papillomavirus
VSGPDIPIN

SEQ ID NO: 48762 - protein, 9 aa, Artificial Sequence
  Peptide Derived from Human Papillomavirus
LHRPALTSR

SEQ ID NO: 48763 - protein, 9 aa, Artificial Sequence
  Peptide Derived from Human Papillomavirus
LVEETSFID

SEQ ID NO: 48764 - protein, 9 aa, Artificial Sequence
  Peptide Derived from Human Papillomavirus
YYYDFSTID

SEQ ID NO: 48765 - protein, 9 aa, Artificial Sequence
  Peptide Derived from Human Papillomavirus
VRPPLTVDP

SEQ ID NO: 48766 - protein, 9 aa, Artificial Sequence
  Peptide Derived from Human Papillomavirus
VALHRPALT

SEQ ID NO: 48767 - protein, 9 aa, Artificial Sequence
  Peptide Derived from Human Papillomavirus
IVPGSPQYT

SEQ ID NO: 48768 - protein, 9 aa, Artificial Sequence
  Peptide Derived from Human Papillomavirus
FFSDVSLAA

SEQ ID NO: 48769 - protein, 9 aa, Artificial Sequence
  Peptide Derived from Human Papillomavirus
YIPANTTIP

SEQ ID NO: 48770 - protein, 9 aa, Artificial Sequence
  Peptide Derived from Human Papillomavirus
LYDIYADDF

SEQ ID NO: 48771 - protein, 9 aa, Artificial Sequence
  Peptide Derived from Human Papillomavirus
VTTVTTHNN

SEQ ID NO: 48772 - protein, 9 aa, Artificial Sequence
  Peptide Derived from Human Papillomavirus
YEGIDVDNT

SEQ ID NO: 48773 - protein, 9 aa, Artificial Sequence
  Peptide Derived from Human Papillomavirus
FTDPSVLQP

SEQ ID NO: 48774 - protein, 9 aa, Artificial Sequence
  Peptide Derived from Human Papillomavirus
IPFGGAYNI

SEQ ID NO: 48775 - protein, 9 aa, Artificial Sequence
  Peptide Derived from Human Papillomavirus
LDINNTVTT

SEQ ID NO: 48776 - protein, 9 aa, Artificial Sequence
  Peptide Derived from Human Papillomavirus
LDIVALHRP

SEQ ID NO: 48777 - protein, 9 aa, Artificial Sequence
  Peptide Derived from Human Papillomavirus
ITDQAPSLI

SEQ ID NO: 48778 - protein, 9 aa, Artificial Sequence
  Peptide Derived from Human Papillomavirus
VDPVGPSDP

SEQ ID NO: 48779 - protein, 9 aa, Artificial Sequence
  Peptide Derived from Human Papillomavirus
VTSSTPIPG

SEQ ID NO: 48780 - protein, 9 aa, Artificial Sequence
  Peptide Derived from Human Papillomavirus
VSGFSITTS

SEQ ID NO: 48781 - protein, 9 aa, Artificial Sequence
  Peptide Derived from Human Papillomavirus
LQPPTPAET

SEQ ID NO: 48782 - protein, 9 aa, Artificial Sequence
  Peptide Derived from Human Papillomavirus
VPSIPPDVS

SEQ ID NO: 48783 - protein, 9 aa, Artificial Sequence
  Peptide Derived from Human Papillomavirus
LPYFFSDVS

SEQ ID NO: 48784 - protein, 9 aa, Artificial Sequence
  Peptide Derived from Human Papillomavirus
LYSRTTQQV

SEQ ID NO: 48785 - protein, 9 aa, Artificial Sequence
  Peptide Derived from Human Papillomavirus
YFFSDVSLA

SEQ ID NO: 48786 - protein, 9 aa, Artificial Sequence
  Peptide Derived from Human Papillomavirus
LTSRRTGIR

SEQ ID NO: 48787 - protein, 9 aa, Artificial Sequence
  Peptide Derived from Human Papillomavirus
LTVDPVGPS

SEQ ID NO: 48788 - protein, 9 aa, Artificial Sequence
  Peptide Derived from Human Papillomavirus
IRYSRIGNK

SEQ ID NO: 48789 - protein, 9 aa, Artificial Sequence
  Peptide Derived from Human Papillomavirus
YIPLGTRPP

SEQ ID NO: 48790 - protein, 9 aa, Artificial Sequence
  Peptide Derived from Human Papillomavirus
IPANTTIPF

SEQ ID NO: 48791 - protein, 9 aa, Artificial Sequence
  Peptide Derived from Human Papillomavirus
VFFGGLGIG

SEQ ID NO: 48792 - protein, 9 aa, Artificial Sequence
  Peptide Derived from Human Papillomavirus
VARLGLYSR

SEQ ID NO: 48793 - protein, 9 aa, Artificial Sequence
  Peptide Derived from Human Papillomavirus
IPGSRPVAR

SEQ ID NO: 48794 - protein, 9 aa, Artificial Sequence
  Peptide Derived from Human Papillomavirus
LSGYIPANT

SEQ ID NO: 48795 - protein, 9 aa, Artificial Sequence
  Peptide Derived from Human Papillomavirus
LAPVRPPLT

SEQ ID NO: 48796 - protein, 9 aa, Artificial Sequence
  Peptide Derived from Human Papillomavirus
YEEIPMDTF

SEQ ID NO: 48797 - protein, 9 aa, Artificial Sequence
  Peptide Derived from Human Papillomavirus
ITYDNPAYE

SEQ ID NO: 48798 - protein, 9 aa, Artificial Sequence
  Peptide Derived from Human Papillomavirus
VKVVDPAFI

SEQ ID NO: 48799 - protein, 9 aa, Artificial Sequence
  Peptide Derived from Human Papillomavirus
IDAGAPTSV

SEQ ID NO: 48800 - protein, 9 aa, Artificial Sequence
  Peptide Derived from Human Papillomavirus
VPSVPSTSL

SEQ ID NO: 48801 - protein, 9 aa, Artificial Sequence
  Peptide Derived from Human Papillomavirus
VGPSDPSIV

SEQ ID NO: 48802 - protein, 9 aa, Artificial Sequence
  Peptide Derived from Human Papillomavirus
YYDFSTIDS

SEQ ID NO: 48803 - protein, 9 aa, Artificial Sequence
  Peptide Derived from Human Papillomavirus
VDPAFITTP

SEQ ID NO: 48804 - protein, 9 aa, Artificial Sequence
  Peptide Derived from Human Papillomavirus
IPPDVSGFS

SEQ ID NO: 48805 - protein, 9 aa, Artificial Sequence
  Peptide Derived from Human Papillomavirus
VPSTSLSGY

SEQ ID NO: 48806 - protein, 9 aa, Artificial Sequence
  Peptide Derived from Human Papillomavirus
FSITTSTDT

SEQ ID NO: 48807 - protein, 9 aa, Artificial Sequence
  Peptide Derived from Human Papillomavirus
YADDFITDT

SEQ ID NO: 48808 - protein, 9 aa, Artificial Sequence
  Peptide Derived from Human Papillomavirus
IDVDNTLYF

SEQ ID NO: 48809 - protein, 9 aa, Artificial Sequence
  Peptide Derived from Human Papillomavirus
LGTRPPTAT

SEQ ID NO: 48810 - protein, 9 aa, Artificial Sequence
  Peptide Derived from Human Papillomavirus
IGNKQTLRT

SEQ ID NO: 48811 - protein, 9 aa, Artificial Sequence
  Peptide Derived from Human Papillomavirus
FSTIDSAEE

SEQ ID NO: 48812 - protein, 9 aa, Artificial Sequence
  Peptide Derived from Human Papillomavirus
FLKSNCQAK

SEQ ID NO: 48813 - protein, 9 aa, Artificial Sequence
  Peptide Derived from Human Papillomavirus
LKDCATMCK

SEQ ID NO: 48814 - protein, 9 aa, Artificial Sequence
  Peptide Derived from Human Papillomavirus
WYRTGISNI

SEQ ID NO: 48815 - protein, 9 aa, Artificial Sequence
  Peptide Derived from Human Papillomavirus
IQPPKLRSS

SEQ ID NO: 48816 - protein, 9 aa, Artificial Sequence
  Peptide Derived from Human Papillomavirus
WFYVQAIVD

SEQ ID NO: 48817 - protein, 9 aa, Artificial Sequence
  Peptide Derived from Human Papillomavirus
VEATQIQVT

SEQ ID NO: 48818 - protein, 9 aa, Artificial Sequence
  Peptide Derived from Human Papillomavirus
YFDTYMRNA

SEQ ID NO: 48819 - protein, 9 aa, Artificial Sequence
  Peptide Derived from Human Papillomavirus
WGVLILALL

SEQ ID NO: 48820 - protein, 9 aa, Artificial Sequence
  Peptide Derived from Human Papillomavirus
FEYALLADS

SEQ ID NO: 48821 - protein, 9 aa, Artificial Sequence
  Peptide Derived from Human Papillomavirus
WPYLESRIT

SEQ ID NO: 48822 - protein, 9 aa, Artificial Sequence
  Peptide Derived from Human Papillomavirus
YGCSEVEAT

SEQ ID NO: 48823 - protein, 9 aa, Artificial Sequence
  Peptide Derived from Human Papillomavirus
FDLSEMVQW

SEQ ID NO: 48824 - protein, 9 aa, Artificial Sequence
  Peptide Derived from Human Papillomavirus
WSRLDLHEE

SEQ ID NO: 48825 - protein, 9 aa, Artificial Sequence
  Peptide Derived from Human Papillomavirus
MAFEYALLA

SEQ ID NO: 48826 - protein, 9 aa, Artificial Sequence
  Peptide Derived from Human Papillomavirus
MLIQPPKLR

SEQ ID NO: 48827 - protein, 9 aa, Artificial Sequence
  Peptide Derived from Human Papillomavirus
YMRNALDGN

SEQ ID NO: 48828 - protein, 9 aa, Artificial Sequence
  Peptide Derived from Human Papillomavirus
FIQGAVISF

SEQ ID NO: 48829 - protein, 9 aa, Artificial Sequence
  Peptide Derived from Human Papillomavirus
YAHIQCLDC

SEQ ID NO: 48830 - protein, 9 aa, Artificial Sequence
  Peptide Derived from Human Papillomavirus
LIQPFILYA

SEQ ID NO: 48831 - protein, 9 aa, Artificial Sequence
  Peptide Derived from Human Papillomavirus
ISFVNSTSH

SEQ ID NO: 48832 - protein, 9 aa, Artificial Sequence
  Peptide Derived from Human Papillomavirus
VCSGGSTEA

SEQ ID NO: 48833 - protein, 9 aa, Artificial Sequence
  Peptide Derived from Human Papillomavirus
FGTFKLRAG

SEQ ID NO: 48834 - protein, 9 aa, Artificial Sequence
  Peptide Derived from Human Papillomavirus
YVQAIVDKK

SEQ ID NO: 48835 - protein, 9 aa, Artificial Sequence
  Peptide Derived from Human Papillomavirus
LIQLKCPPI

SEQ ID NO: 48836 - protein, 9 aa, Artificial Sequence
  Peptide Derived from Human Papillomavirus
ITFLGALKS

SEQ ID NO: 48837 - protein, 9 aa, Artificial Sequence
  Peptide Derived from Human Papillomavirus
VNPQCTIAQ

SEQ ID NO: 48838 - protein, 9 aa, Artificial Sequence
  Peptide Derived from Human Papillomavirus
VNPTIAEGF

SEQ ID NO: 48839 - protein, 9 aa, Artificial Sequence
  Peptide Derived from Human Papillomavirus
IQGAVISFV

SEQ ID NO: 48840 - protein, 9 aa, Artificial Sequence
  Peptide Derived from Human Papillomavirus
LLRYKCGKS

SEQ ID NO: 48841 - protein, 9 aa, Artificial Sequence
  Peptide Derived from Human Papillomavirus
VMGDTPEWI

SEQ ID NO: 48842 - protein, 9 aa, Artificial Sequence
  Peptide Derived from Human Papillomavirus
LGALKSFLK

SEQ ID NO: 48843 - protein, 9 aa, Artificial Sequence
  Peptide Derived from Human Papillomavirus
FEFPNAFPF

SEQ ID NO: 48844 - protein, 9 aa, Artificial Sequence
  Peptide Derived from Human Papillomavirus
FERTWSRLD

SEQ ID NO: 48845 - protein, 9 aa, Artificial Sequence
  Peptide Derived from Human Papillomavirus
YGLSFTDLV

SEQ ID NO: 48846 - protein, 9 aa, Artificial Sequence
  Peptide Derived from Human Papillomavirus
LVFCGPANT

SEQ ID NO: 48847 - protein, 9 aa, Artificial Sequence
  Peptide Derived from Human Papillomavirus
IQLKCPPIL

SEQ ID NO: 48848 - protein, 9 aa, Artificial Sequence
  Peptide Derived from Human Papillomavirus
FAGGSTENS

SEQ ID NO: 48849 - protein, 9 aa, Artificial Sequence
  Peptide Derived from Human Papillomavirus
FGMSFIHFI

SEQ ID NO: 48850 - protein, 9 aa, Artificial Sequence
  Peptide Derived from Human Papillomavirus
IQPFILYAH

SEQ ID NO: 48851 - protein, 9 aa, Artificial Sequence
  Peptide Derived from Human Papillomavirus
MLDDATTTC

SEQ ID NO: 48852 - protein, 9 aa, Artificial Sequence
  Peptide Derived from Human Papillomavirus
VLILALLRY

SEQ ID NO: 48853 - protein, 9 aa, Artificial Sequence
  Peptide Derived from Human Papillomavirus
LTDTKVAML

SEQ ID NO: 48854 - protein, 9 aa, Artificial Sequence
  Peptide Derived from Human Papillomavirus
LKRKFAGGS

SEQ ID NO: 48855 - protein, 9 aa, Artificial Sequence
  Peptide Derived from Human Papillomavirus
LKCPPILLT

SEQ ID NO: 48856 - protein, 9 aa, Artificial Sequence
  Peptide Derived from Human Papillomavirus
FLKGTPKKN

SEQ ID NO: 48857 - protein, 9 aa, Artificial Sequence
  Peptide Derived from Human Papillomavirus
VPETCMLIQ

SEQ ID NO: 48858 - protein, 9 aa, Artificial Sequence
  Peptide Derived from Human Papillomavirus
YKCGKSRLT

SEQ ID NO: 48859 - protein, 9 aa, Artificial Sequence
  Peptide Derived from Human Papillomavirus
YRTGISNIS

SEQ ID NO: 48860 - protein, 9 aa, Artificial Sequence
  Peptide Derived from Human Papillomavirus
WIRFRCSKI

SEQ ID NO: 48861 - protein, 9 aa, Artificial Sequence
  Peptide Derived from Human Papillomavirus
VFCGPANTG

SEQ ID NO: 48862 - protein, 9 aa, Artificial Sequence
  Peptide Derived from Human Papillomavirus
FYVQAIVDK

SEQ ID NO: 48863 - protein, 9 aa, Artificial Sequence
  Peptide Derived from Human Papillomavirus
IENVNPQCT

SEQ ID NO: 48864 - protein, 9 aa, Artificial Sequence
  Peptide Derived from Human Papillomavirus
IQRLTIIQH

SEQ ID NO: 48865 - protein, 9 aa, Artificial Sequence
  Peptide Derived from Human Papillomavirus
LLTTNIHPA

SEQ ID NO: 48866 - protein, 9 aa, Artificial Sequence
  Peptide Derived from Human Papillomavirus
LRSSVAALY

SEQ ID NO: 48867 - protein, 9 aa, Artificial Sequence
  Peptide Derived from Human Papillomavirus
LETAQALFH

SEQ ID NO: 48868 - protein, 9 aa, Artificial Sequence
  Peptide Derived from Human Papillomavirus
YLKDCATMC

SEQ ID NO: 48869 - protein, 9 aa, Artificial Sequence
  Peptide Derived from Human Papillomavirus
FHAQEVHND

SEQ ID NO: 48870 - protein, 9 aa, Artificial Sequence
  Peptide Derived from Human Papillomavirus
ILYAHIQCL

SEQ ID NO: 48871 - protein, 9 aa, Artificial Sequence
  Peptide Derived from Human Papillomavirus
FDNELTDES

SEQ ID NO: 48872 - protein, 9 aa, Artificial Sequence
  Peptide Derived from Human Papillomavirus
VDTELSPRL

SEQ ID NO: 48873 - protein, 9 aa, Artificial Sequence
  Peptide Derived from Human Papillomavirus
IIQHGIDDS

SEQ ID NO: 48874 - protein, 9 aa, Artificial Sequence
  Peptide Derived from Human Papillomavirus
VAKGLSTLL

SEQ ID NO: 48875 - protein, 9 aa, Artificial Sequence
  Peptide Derived from Human Papillomavirus
LDGNPISID

SEQ ID NO: 48876 - protein, 9 aa, Artificial Sequence
  Peptide Derived from Human Papillomavirus
FTISDSGYG

SEQ ID NO: 48877 - protein, 9 aa, Artificial Sequence
  Peptide Derived from Human Papillomavirus
YLESRITVF

SEQ ID NO: 48878 - protein, 9 aa, Artificial Sequence
  Peptide Derived from Human Papillomavirus
VDFIDTQGT

SEQ ID NO: 48879 - protein, 9 aa, Artificial Sequence
  Peptide Derived from Human Papillomavirus
WLEPLTDTK

SEQ ID NO: 48880 - protein, 9 aa, Artificial Sequence
  Peptide Derived from Human Papillomavirus
LQEISLNSG

SEQ ID NO: 48881 - protein, 9 aa, Artificial Sequence
  Peptide Derived from Human Papillomavirus
IRFRCSKID

SEQ ID NO: 48882 - protein, 9 aa, Artificial Sequence
  Peptide Derived from Human Papillomavirus
LHVPETCML

SEQ ID NO: 48883 - protein, 9 aa, Artificial Sequence
  Peptide Derived from Human Papillomavirus
FGVNPTIAE

SEQ ID NO: 48884 - protein, 9 aa, Artificial Sequence
  Peptide Derived from Human Papillomavirus
VRNFKSDKT

SEQ ID NO: 48885 - protein, 9 aa, Artificial Sequence
  Peptide Derived from Human Papillomavirus
IDNGGTEGN

SEQ ID NO: 48886 - protein, 9 aa, Artificial Sequence
  Peptide Derived from Human Papillomavirus
WIQRLTIIQ

SEQ ID NO: 48887 - protein, 9 aa, Artificial Sequence
  Peptide Derived from Human Papillomavirus
FWLEPLTDT

SEQ ID NO: 48888 - protein, 9 aa, Artificial Sequence
  Peptide Derived from Human Papillomavirus
WTYFDTYMR

SEQ ID NO: 48889 - protein, 9 aa, Artificial Sequence
  Peptide Derived from Human Papillomavirus
LSFTDLVRN

SEQ ID NO: 48890 - protein, 9 aa, Artificial Sequence
  Peptide Derived from Human Papillomavirus
LYWYRTGIS

SEQ ID NO: 48891 - protein, 9 aa, Artificial Sequence
  Peptide Derived from Human Papillomavirus
LDDATTTCW

SEQ ID NO: 48892 - protein, 9 aa, Artificial Sequence
  Peptide Derived from Human Papillomavirus
IDTQGTFCE

SEQ ID NO: 48893 - protein, 9 aa, Artificial Sequence
  Peptide Derived from Human Papillomavirus
FPNAFPFDK

SEQ ID NO: 48894 - protein, 9 aa, Artificial Sequence
  Peptide Derived from Human Papillomavirus
FVNSTSHFW

SEQ ID NO: 48895 - protein, 9 aa, Artificial Sequence
  Peptide Derived from Human Papillomavirus
IVDKKTGDV

SEQ ID NO: 48896 - protein, 9 aa, Artificial Sequence
  Peptide Derived from Human Papillomavirus
LRYQQIEFI

SEQ ID NO: 48897 - protein, 9 aa, Artificial Sequence
  Peptide Derived from Human Papillomavirus
FKSDKTTCT

SEQ ID NO: 48898 - protein, 9 aa, Artificial Sequence
  Peptide Derived from Human Papillomavirus
IFGVNPTIA

SEQ ID NO: 48899 - protein, 9 aa, Artificial Sequence
  Peptide Derived from Human Papillomavirus
LILALLRYK

SEQ ID NO: 48900 - protein, 9 aa, Artificial Sequence
  Peptide Derived from Human Papillomavirus
FRCSKIDEG

SEQ ID NO: 48901 - protein, 9 aa, Artificial Sequence
  Peptide Derived from Human Papillomavirus
LESRITVFE

SEQ ID NO: 48902 - protein, 9 aa, Artificial Sequence
  Peptide Derived from Human Papillomavirus
IQCLDCKWG

SEQ ID NO: 48903 - protein, 9 aa, Artificial Sequence
  Peptide Derived from Human Papillomavirus
LADSNSNAA

SEQ ID NO: 48904 - protein, 9 aa, Artificial Sequence
  Peptide Derived from Human Papillomavirus
WDKTATCVS

SEQ ID NO: 48905 - protein, 9 aa, Artificial Sequence
  Peptide Derived from Human Papillomavirus
YGQTSAATR

SEQ ID NO: 48906 - protein, 9 aa, Artificial Sequence
  Peptide Derived from Human Papillomavirus
VSHRGLYYV

SEQ ID NO: 48907 - protein, 9 aa, Artificial Sequence
  Peptide Derived from Human Papillomavirus
ISKSKAHKA

SEQ ID NO: 48908 - protein, 9 aa, Artificial Sequence
  Peptide Derived from Human Papillomavirus
LWNTEPTHC

SEQ ID NO: 48909 - protein, 9 aa, Artificial Sequence
  Peptide Derived from Human Papillomavirus
YGNTGTWEV

SEQ ID NO: 48910 - protein, 9 aa, Artificial Sequence
  Peptide Derived from Human Papillomavirus
YVAWDSVYY

SEQ ID NO: 48911 - protein, 9 aa, Artificial Sequence
  Peptide Derived from Human Papillomavirus
VSATQLVKQ

SEQ ID NO: 48912 - protein, 9 aa, Artificial Sequence
  Peptide Derived from Human Papillomavirus
IQYWQLIRW

SEQ ID NO: 48913 - protein, 9 aa, Artificial Sequence
  Peptide Derived from Human Papillomavirus
YYMTDAGTW

SEQ ID NO: 48914 - protein, 9 aa, Artificial Sequence
  Peptide Derived from Human Papillomavirus
WNTEPTHCF

SEQ ID NO: 48915 - protein, 9 aa, Artificial Sequence
  Peptide Derived from Human Papillomavirus
MALQGLAQS

SEQ ID NO: 48916 - protein, 9 aa, Artificial Sequence
  Peptide Derived from Human Papillomavirus
FGNNVIDCN

SEQ ID NO: 48917 - protein, 9 aa, Artificial Sequence
  Peptide Derived from Human Papillomavirus
IELQMALQG

SEQ ID NO: 48918 - protein, 9 aa, Artificial Sequence
  Peptide Derived from Human Papillomavirus
VPAYNISKS

SEQ ID NO: 48919 - protein, 9 aa, Artificial Sequence
  Peptide Derived from Human Papillomavirus
LNHQVVPAY

SEQ ID NO: 48920 - protein, 9 aa, Artificial Sequence
  Peptide Derived from Human Papillomavirus
YNTFYIEFK

SEQ ID NO: 48921 - protein, 9 aa, Artificial Sequence
  Peptide Derived from Human Papillomavirus
LSERLSCVQ

SEQ ID NO: 48922 - protein, 9 aa, Artificial Sequence
  Peptide Derived from Human Papillomavirus
VAIPDSVQI

SEQ ID NO: 48923 - protein, 9 aa, Artificial Sequence
  Peptide Derived from Human Papillomavirus
VQDKIIDHY

SEQ ID NO: 48924 - protein, 9 aa, Artificial Sequence
  Peptide Derived from Human Papillomavirus
VAWDSVYYM

SEQ ID NO: 48925 - protein, 9 aa, Artificial Sequence
  Peptide Derived from Human Papillomavirus
IDCNDSMCS

SEQ ID NO: 48926 - protein, 9 aa, Artificial Sequence
  Peptide Derived from Human Papillomavirus
LGAATPTGN

SEQ ID NO: 48927 - protein, 9 aa, Artificial Sequence
  Peptide Derived from Human Papillomavirus
YIEFKSECE

SEQ ID NO: 48928 - protein, 9 aa, Artificial Sequence
  Peptide Derived from Human Papillomavirus
YSSTVSVGT

SEQ ID NO: 48929 - protein, 9 aa, Artificial Sequence
  Peptide Derived from Human Papillomavirus
LCSGNTTPI

SEQ ID NO: 48930 - protein, 9 aa, Artificial Sequence
  Peptide Derived from Human Papillomavirus
FLNTVAIPD

SEQ ID NO: 48931 - protein, 9 aa, Artificial Sequence
  Peptide Derived from Human Papillomavirus
YRDISSTWH

SEQ ID NO: 48932 - protein, 9 aa, Artificial Sequence
  Peptide Derived from Human Papillomavirus
VSVGTAKTY

SEQ ID NO: 48933 - protein, 9 aa, Artificial Sequence
  Peptide Derived from Human Papillomavirus
WHWTGAGNE

SEQ ID NO: 48934 - protein, 9 aa, Artificial Sequence
  Peptide Derived from Human Papillomavirus
WTLQDTCEE

SEQ ID NO: 48935 - protein, 9 aa, Artificial Sequence
  Peptide Derived from Human Papillomavirus
LNTVAIPDS

SEQ ID NO: 48936 - protein, 9 aa, Artificial Sequence
  Peptide Derived from Human Papillomavirus
VGTAKTYGQ

SEQ ID NO: 48937 - protein, 9 aa, Artificial Sequence
  Peptide Derived from Human Papillomavirus
LQHTPSPYS

SEQ ID NO: 48938 - protein, 9 aa, Artificial Sequence
  Peptide Derived from Human Papillomavirus
LLGAATPTG

SEQ ID NO: 48939 - protein, 9 aa, Artificial Sequence
  Peptide Derived from Human Papillomavirus
YNISKSKAH

SEQ ID NO: 48940 - protein, 9 aa, Artificial Sequence
  Peptide Derived from Human Papillomavirus
MTDAGTWDK

SEQ ID NO: 48941 - protein, 9 aa, Artificial Sequence
  Peptide Derived from Human Papillomavirus
IRWENAIFF

SEQ ID NO: 48942 - protein, 9 aa, Artificial Sequence
  Peptide Derived from Human Papillomavirus
LSLIFLFCF

SEQ ID NO: 48943 - protein, 9 aa, Artificial Sequence
  Peptide Derived from Human Papillomavirus
LVFVYIVVI

SEQ ID NO: 48944 - protein, 9 aa, Artificial Sequence
  Peptide Derived from Human Papillomavirus
WVLVFVYIV

SEQ ID NO: 48945 - protein, 9 aa, Artificial Sequence
  Peptide Derived from Human Papillomavirus
VPLLPSVCM

SEQ ID NO: 48946 - protein, 9 aa, Artificial Sequence
  Peptide Derived from Human Papillomavirus
VCMYVCCHV

SEQ ID NO: 48947 - protein, 9 aa, Artificial Sequence
  Peptide Derived from Human Papillomavirus
LPMLLLHIH

SEQ ID NO: 48948 - protein, 9 aa, Artificial Sequence
  Peptide Derived from Human Papillomavirus
VCCHVPLLP

SEQ ID NO: 48949 - protein, 9 aa, Artificial Sequence
  Peptide Derived from Human Papillomavirus
LLPMLLLHI

SEQ ID NO: 48950 - protein, 9 aa, Artificial Sequence
  Peptide Derived from Human Papillomavirus
YVFCFLLPM

SEQ ID NO: 48951 - protein, 9 aa, Artificial Sequence
  Peptide Derived from Human Papillomavirus
IVVITSPAT

SEQ ID NO: 48952 - protein, 9 aa, Artificial Sequence
  Peptide Derived from Human Papillomavirus
LLPSVCMCA

SEQ ID NO: 48953 - protein, 9 aa, Artificial Sequence
  Peptide Derived from Human Papillomavirus
FCFCVCMYV

SEQ ID NO: 48954 - protein, 9 aa, Artificial Sequence
  Peptide Derived from Human Papillomavirus
ITSPATAFT

SEQ ID NO: 48955 - protein, 9 aa, Artificial Sequence
  Peptide Derived from Human Papillomavirus
LFCFCVCMY

SEQ ID NO: 48956 - protein, 9 aa, Artificial Sequence
  Peptide Derived from Human Papillomavirus
MLLLHIHAI

SEQ ID NO: 48957 - protein, 9 aa, Artificial Sequence
  Peptide Derived from Human Papillomavirus
VYIVVITSP

SEQ ID NO: 48958 - protein, 9 aa, Artificial Sequence
  Peptide Derived from Human Papillomavirus
YAWVLVFVY

SEQ ID NO: 48959 - protein, 9 aa, Artificial Sequence
  Peptide Derived from Human Papillomavirus
LHIHAILSL

SEQ ID NO: 48960 - protein, 9 aa, Artificial Sequence
  Peptide Derived from Human Papillomavirus
LIFLFCFCV

SEQ ID NO: 48961 - protein, 9 aa, Artificial Sequence
  Peptide Derived from Human Papillomavirus
LLHIHAILS

SEQ ID NO: 48962 - protein, 9 aa, Artificial Sequence
  Peptide Derived from Human Papillomavirus
FLFCFCVCM

SEQ ID NO: 48963 - protein, 9 aa, Artificial Sequence
  Peptide Derived from Human Papillomavirus
VFCFLLPML

SEQ ID NO: 48964 - protein, 9 aa, Artificial Sequence
  Peptide Derived from Human Papillomavirus
YVCCHVPLL

SEQ ID NO: 48965 - protein, 9 aa, Artificial Sequence
  Peptide Derived from Human Papillomavirus
FLLPMLLLH

SEQ ID NO: 48966 - protein, 9 aa, Artificial Sequence
  Peptide Derived from Human Papillomavirus
YIVVITSPA

SEQ ID NO: 48967 - protein, 9 aa, Artificial Sequence
  Peptide Derived from Human Papillomavirus
FVYIVVITS

SEQ ID NO: 48968 - protein, 9 aa, Artificial Sequence
  Peptide Derived from Human Papillomavirus
LPSVCMCAY

SEQ ID NO: 48969 - protein, 9 aa, Artificial Sequence
  Peptide Derived from Human Papillomavirus
VVITSPATA

SEQ ID NO: 48970 - protein, 9 aa, Artificial Sequence
  Peptide Derived from Human Papillomavirus
FCFLLPMLL

SEQ ID NO: 48971 - protein, 9 aa, Artificial Sequence
  Peptide Derived from Human Papillomavirus
VFVYIVVIT

SEQ ID NO: 48972 - protein, 9 aa, Artificial Sequence
  Peptide Derived from Human Papillomavirus
VITSPATAF

SEQ ID NO: 48973 - protein, 9 aa, Artificial Sequence
  Peptide Derived from Human Papillomavirus
ITCVYCKTV

SEQ ID NO: 48974 - protein, 9 aa, Artificial Sequence
  Peptide Derived from Human Papillomavirus
VVYRDSIPH

SEQ ID NO: 48975 - protein, 9 aa, Artificial Sequence
  Peptide Derived from Human Papillomavirus
FKDLFVVYR

SEQ ID NO: 48976 - protein, 9 aa, Artificial Sequence
  Peptide Derived from Human Papillomavirus
YRDSIPHAA

SEQ ID NO: 48977 - protein, 9 aa, Artificial Sequence
  Peptide Derived from Human Papillomavirus
LRCQKPLNP

SEQ ID NO: 48978 - protein, 9 aa, Artificial Sequence
  Peptide Derived from Human Papillomavirus
VYCKTVLEL

SEQ ID NO: 48979 - protein, 9 aa, Artificial Sequence
  Peptide Derived from Human Papillomavirus
LELTEVFEF

SEQ ID NO: 48980 - protein, 9 aa, Artificial Sequence
  Peptide Derived from Human Papillomavirus
LTNTGLYNL

SEQ ID NO: 48981 - protein, 9 aa, Artificial Sequence
  Peptide Derived from Human Papillomavirus
VYRDSIPHA

SEQ ID NO: 48982 - protein, 9 aa, Artificial Sequence
  Peptide Derived from Human Papillomavirus
IEITCVYCK

SEQ ID NO: 48983 - protein, 9 aa, Artificial Sequence
  Peptide Derived from Human Papillomavirus
LLIRCLRCQ

SEQ ID NO: 48984 - protein, 9 aa, Artificial Sequence
  Peptide Derived from Human Papillomavirus
IRCLRCQKP

SEQ ID NO: 48985 - protein, 9 aa, Artificial Sequence
  Peptide Derived from Human Papillomavirus
LYNLLIRCL

SEQ ID NO: 48986 - protein, 9 aa, Artificial Sequence
  Peptide Derived from Human Papillomavirus
LQDIEITCV

SEQ ID NO: 48987 - protein, 9 aa, Artificial Sequence
  Peptide Derived from Human Papillomavirus
LPDLCTELN

SEQ ID NO: 48988 - protein, 9 aa, Artificial Sequence
  Peptide Derived from Human Papillomavirus
IPHAACHKC

SEQ ID NO: 48989 - protein, 9 aa, Artificial Sequence
  Peptide Derived from Human Papillomavirus
YKLPDLCTE

SEQ ID NO: 48990 - protein, 9 aa, Artificial Sequence
  Peptide Derived from Human Papillomavirus
VYGDTLEKL

SEQ ID NO: 48991 - protein, 9 aa, Artificial Sequence
  Peptide Derived from Human Papillomavirus
YCKTVLELT

SEQ ID NO: 48992 - protein, 9 aa, Artificial Sequence
  Peptide Derived from Human Papillomavirus
FAFKDLFVV

SEQ ID NO: 48993 - protein, 9 aa, Artificial Sequence
  Peptide Derived from Human Papillomavirus
MHGPKATLQ

SEQ ID NO: 48994 - protein, 9 aa, Artificial Sequence
  Peptide Derived from Human Papillomavirus
LFLNTLSFV

SEQ ID NO: 48995 - protein, 9 aa, Artificial Sequence
  Peptide Derived from Human Papillomavirus
LPARRAEPQ

SEQ ID NO: 48996 - protein, 9 aa, Artificial Sequence
  Peptide Derived from Human Papillomavirus
VNHQHLPAR

SEQ ID NO: 48997 - protein, 9 aa, Artificial Sequence
  Peptide Derived from Human Papillomavirus
VVESSADDL

SEQ ID NO: 48998 - protein, 9 aa, Artificial Sequence
  Peptide Derived from Human Papillomavirus
LQDIVLHLE

SEQ ID NO: 48999 - protein, 9 aa, Artificial Sequence
  Peptide Derived from Human Papillomavirus
LSFVCPWCA

SEQ ID NO: 49000 - protein, 9 aa, Artificial Sequence
  Peptide Derived from Human Papillomavirus
FQQLFLNTL

SEQ ID NO: 49001 - protein, 9 aa, Artificial Sequence
  Peptide Derived from Human Papillomavirus
VCPWCASQQ

SEQ ID NO: 49002 - protein, 9 aa, Artificial Sequence
  Peptide Derived from Human Papillomavirus
VLHLEPQNE

SEQ ID NO: 49003 - protein, 9 aa, Artificial Sequence
  Peptide Derived from Human Papillomavirus
IPVDLLCHE

SEQ ID NO: 49004 - protein, 9 aa, Artificial Sequence
  Peptide Derived from Human Papillomavirus
FLNTLSFVC

SEQ ID NO: 49005 - protein, 9 aa, Artificial Sequence
  Peptide Derived from Human Papillomavirus
MLCMCCKCE

SEQ ID NO: 49006 - protein, 9 aa, Artificial Sequence
  Peptide Derived from Human Papillomavirus
LVVESSADD

SEQ ID NO: 49007 - protein, 9 aa, Artificial Sequence
  Peptide Derived from Human Papillomavirus
FVCPWCASQ

SEQ ID NO: 49008 - protein, 9 aa, Artificial Sequence
  Peptide Derived from Human Papillomavirus
LCHEQLSDS

SEQ ID NO: 49009 - protein, 9 aa, Artificial Sequence
  Peptide Derived from Human Papillomavirus
LYTRVLILH

SEQ ID NO: 49010 - protein, 9 aa, Artificial Sequence
  Peptide Derived from Human Papillomavirus
MSYIHSMNS

SEQ ID NO: 49011 - protein, 9 aa, Artificial Sequence
  Peptide Derived from Human Papillomavirus
MGDTVPQSL

SEQ ID NO: 49012 - protein, 9 aa, Artificial Sequence
  Peptide Derived from Human Papillomavirus
IGEHWAKGT

SEQ ID NO: 49013 - protein, 9 aa, Artificial Sequence
  Peptide Derived from Human Papillomavirus
YRVFRVQLP

SEQ ID NO: 49014 - protein, 9 aa, Artificial Sequence
  Peptide Derived from Human Papillomavirus
YIILFLRNV

SEQ ID NO: 49015 - protein, 9 aa, Artificial Sequence
  Peptide Derived from Human Papillomavirus
LELKNTVLE

SEQ ID NO: 49016 - protein, 9 aa, Artificial Sequence
  Peptide Derived from Human Papillomavirus
VTPTSIFYH

SEQ ID NO: 49017 - protein, 9 aa, Artificial Sequence
  Peptide Derived from Human Papillomavirus
FIFQLCTIT

SEQ ID NO: 49018 - protein, 9 aa, Artificial Sequence
  Peptide Derived from Human Papillomavirus
VYLPPPSVA

SEQ ID NO: 49019 - protein, 9 aa, Artificial Sequence
  Peptide Derived from Human Papillomavirus
IYNPETQRL

SEQ ID NO: 49020 - protein, 9 aa, Artificial Sequence
  Peptide Derived from Human Papillomavirus
FGVPPPPTT

SEQ ID NO: 49021 - protein, 9 aa, Artificial Sequence
  Peptide Derived from Human Papillomavirus
LDICQSICK

SEQ ID NO: 49022 - protein, 9 aa, Artificial Sequence
  Peptide Derived from Human Papillomavirus
LRREQLFAR

SEQ ID NO: 49023 - protein, 9 aa, Artificial Sequence
  Peptide Derived from Human Papillomavirus
MALWRPSDN

SEQ ID NO: 49024 - protein, 9 aa, Artificial Sequence
  Peptide Derived from Human Papillomavirus
FLQMALWRP

SEQ ID NO: 49025 - protein, 9 aa, Artificial Sequence
  Peptide Derived from Human Papillomavirus
LQDTKCEVP

SEQ ID NO: 49026 - protein, 9 aa, Artificial Sequence
  Peptide Derived from Human Papillomavirus
VVDTTPSTN

SEQ ID NO: 49027 - protein, 9 aa, Artificial Sequence
  Peptide Derived from Human Papillomavirus
WAKGTACKS

SEQ ID NO: 49028 - protein, 9 aa, Artificial Sequence
  Peptide Derived from Human Papillomavirus
YFRVPAGGG

SEQ ID NO: 49029 - protein, 9 aa, Artificial Sequence
  Peptide Derived from Human Papillomavirus
YHPRPLPLH

SEQ ID NO: 49030 - protein, 9 aa, Artificial Sequence
  Peptide Derived from Human Papillomavirus
LGVGLSGHP

SEQ ID NO: 49031 - protein, 9 aa, Artificial Sequence
  Peptide Derived from Human Papillomavirus
VYSPSPSGS

SEQ ID NO: 49032 - protein, 9 aa, Artificial Sequence
  Peptide Derived from Human Papillomavirus
IGRGQPLGV

SEQ ID NO: 49033 - protein, 9 aa, Artificial Sequence
  Peptide Derived from Human Papillomavirus
ICGHYIILF

SEQ ID NO: 49034 - protein, 9 aa, Artificial Sequence
  Peptide Derived from Human Papillomavirus
LFVTVVDTT

SEQ ID NO: 49035 - protein, 9 aa, Artificial Sequence
  Peptide Derived from Human Papillomavirus
LCTITLTAD

SEQ ID NO: 49036 - protein, 9 aa, Artificial Sequence
  Peptide Derived from Human Papillomavirus
MNSSILEDW

SEQ ID NO: 49037 - protein, 9 aa, Artificial Sequence
  Peptide Derived from Human Papillomavirus
LRNVNVFPI

SEQ ID NO: 49038 - protein, 9 aa, Artificial Sequence
  Peptide Derived from Human Papillomavirus
YHLLPLYGP

SEQ ID NO: 49039 - protein, 9 aa, Artificial Sequence
  Peptide Derived from Human Papillomavirus
YMVHIIICG

SEQ ID NO: 49040 - protein, 9 aa, Artificial Sequence
  Peptide Derived from Human Papillomavirus
VPLDICQSI

SEQ ID NO: 49041 - protein, 9 aa, Artificial Sequence
  Peptide Derived from Human Papillomavirus
LPDTSIYNP

SEQ ID NO: 49042 - protein, 9 aa, Artificial Sequence
  Peptide Derived from Human Papillomavirus
FWNVDLKEK

SEQ ID NO: 49043 - protein, 9 aa, Artificial Sequence
  Peptide Derived from Human Papillomavirus
IPKVSAYQY

SEQ ID NO: 49044 - protein, 9 aa, Artificial Sequence
  Peptide Derived from Human Papillomavirus
LGCAPAIGE

SEQ ID NO: 49045 - protein, 9 aa, Artificial Sequence
  Peptide Derived from Human Papillomavirus
WNFGVPPPP

SEQ ID NO: 49046 - protein, 9 aa, Artificial Sequence
  Peptide Derived from Human Papillomavirus
ILVYMVHII

SEQ ID NO: 49047 - protein, 9 aa, Artificial Sequence
  Peptide Derived from Human Papillomavirus
IFQLCTITL

SEQ ID NO: 49048 - protein, 9 aa, Artificial Sequence
  Peptide Derived from Human Papillomavirus
VNVFPIFLQ

SEQ ID NO: 49049 - protein, 9 aa, Artificial Sequence
  Peptide Derived from Human Papillomavirus
MVHIIICGH

SEQ ID NO: 49050 - protein, 9 aa, Artificial Sequence
  Peptide Derived from Human Papillomavirus
YTRVLILHY

SEQ ID NO: 49051 - protein, 9 aa, Artificial Sequence
  Peptide Derived from Human Papillomavirus
IHSMNSSIL

SEQ ID NO: 49052 - protein, 9 aa, Artificial Sequence
  Peptide Derived from Human Papillomavirus
VPPPPTTSL

SEQ ID NO: 49053 - protein, 9 aa, Artificial Sequence
  Peptide Derived from Human Papillomavirus
YWLHKAQGH

SEQ ID NO: 49054 - protein, 9 aa, Artificial Sequence
  Peptide Derived from Human Papillomavirus
LEDGDMVDT

SEQ ID NO: 49055 - protein, 9 aa, Artificial Sequence
  Peptide Derived from Human Papillomavirus
YLPPPSVAR

SEQ ID NO: 49056 - protein, 9 aa, Artificial Sequence
  Peptide Derived from Human Papillomavirus
LKEKFSLDL

SEQ ID NO: 49057 - protein, 9 aa, Artificial Sequence
  Peptide Derived from Human Papillomavirus
VFPIFLQMA

SEQ ID NO: 49058 - protein, 9 aa, Artificial Sequence
  Peptide Derived from Human Papillomavirus
VDYKQTQLC

SEQ ID NO: 49059 - protein, 9 aa, Artificial Sequence
  Peptide Derived from Human Papillomavirus
ICQSICKYP

SEQ ID NO: 49060 - protein, 9 aa, Artificial Sequence
  Peptide Derived from Human Papillomavirus
LKNTVLEDG

SEQ ID NO: 49061 - protein, 9 aa, Artificial Sequence
  Peptide Derived from Human Papillomavirus
LHSILVYMV

SEQ ID NO: 49062 - protein, 9 aa, Artificial Sequence
  Peptide Derived from Human Papillomavirus
FGLPDTSIY

SEQ ID NO: 49063 - protein, 9 aa, Artificial Sequence
  Peptide Derived from Human Papillomavirus
LYIKGTGMP

SEQ ID NO: 49064 - protein, 9 aa, Artificial Sequence
  Peptide Derived from Human Papillomavirus
LPLHSILVY

SEQ ID NO: 49065 - protein, 9 aa, Artificial Sequence
  Peptide Derived from Human Papillomavirus
LRRKPTIGP

SEQ ID NO: 49066 - protein, 9 aa, Artificial Sequence
  Peptide Derived from Human Papillomavirus
FQLCTITLT

SEQ ID NO: 49067 - protein, 9 aa, Artificial Sequence
  Peptide Derived from Human Papillomavirus
ILGCAPAIG

SEQ ID NO: 49068 - protein, 9 aa, Artificial Sequence
  Peptide Derived from Human Papillomavirus
VTVVDTTPS

SEQ ID NO: 49069 - protein, 9 aa, Artificial Sequence
  Peptide Derived from Human Papillomavirus
LCILGCAPA

SEQ ID NO: 49070 - protein, 9 aa, Artificial Sequence
  Peptide Derived from Human Papillomavirus
LGRKFLVQA

SEQ ID NO: 49071 - protein, 9 aa, Artificial Sequence
  Peptide Derived from Human Papillomavirus
VFRVQLPDP

SEQ ID NO: 49072 - protein, 9 aa, Artificial Sequence
  Peptide Derived from Human Papillomavirus
WNRAGTMGD

SEQ ID NO: 49073 - protein, 9 aa, Artificial Sequence
  Peptide Derived from Human Papillomavirus
LVQAGLRRK

SEQ ID NO: 49074 - protein, 9 aa, Artificial Sequence
  Peptide Derived from Human Papillomavirus
WACAGVEIG

SEQ ID NO: 49075 - protein, 9 aa, Artificial Sequence
  Peptide Derived from Human Papillomavirus
ILHYHLLPL

SEQ ID NO: 49076 - protein, 9 aa, Artificial Sequence
  Peptide Derived from Human Papillomavirus
YSPSPSGSI

SEQ ID NO: 49077 - protein, 9 aa, Artificial Sequence
  Peptide Derived from Human Papillomavirus
VRDNVSVDY

SEQ ID NO: 49078 - protein, 9 aa, Artificial Sequence
  Peptide Derived from Human Papillomavirus
IVTSDSQLF

SEQ ID NO: 49079 - protein, 9 aa, Artificial Sequence
  Peptide Derived from Human Papillomavirus
YHAGSSRLL

SEQ ID NO: 49080 - protein, 9 aa, Artificial Sequence
  Peptide Derived from Human Papillomavirus
VYMVHIIIC

SEQ ID NO: 49081 - protein, 9 aa, Artificial Sequence
  Peptide Derived from Human Papillomavirus
LDQYPLGRK

SEQ ID NO: 49082 - protein, 9 aa, Artificial Sequence
  Peptide Derived from Human Papillomavirus
IKGTGMPAS

SEQ ID NO: 49083 - protein, 9 aa, Artificial Sequence
  Peptide Derived from Human Papillomavirus
VEEYDLQFI

SEQ ID NO: 49084 - protein, 9 aa, Artificial Sequence
  Peptide Derived from Human Papillomavirus
LTVGNPYFR

SEQ ID NO: 49085 - protein, 9 aa, Artificial Sequence
  Peptide Derived from Human Papillomavirus
LSQGDCPPL

SEQ ID NO: 49086 - protein, 9 aa, Artificial Sequence
  Peptide Derived from Human Papillomavirus
LTICASTQS

SEQ ID NO: 49087 - protein, 9 aa, Artificial Sequence
  Peptide Derived from Human Papillomavirus
YKQTQLCIL

SEQ ID NO: 49088 - protein, 9 aa, Artificial Sequence
  Peptide Derived from Human Papillomavirus
YVTPTSIFY

SEQ ID NO: 49089 - protein, 9 aa, Artificial Sequence
  Peptide Derived from Human Papillomavirus
LTADVMSYI

SEQ ID NO: 49090 - protein, 9 aa, Artificial Sequence
  Peptide Derived from Human Papillomavirus
LVWACAGVE

SEQ ID NO: 49091 - protein, 9 aa, Artificial Sequence
  Peptide Derived from Human Papillomavirus
FYHAGSSRL

SEQ ID NO: 49092 - protein, 9 aa, Artificial Sequence
  Peptide Derived from Human Papillomavirus
LPPPSVARV

SEQ ID NO: 49093 - protein, 9 aa, Artificial Sequence
  Peptide Derived from Human Papillomavirus
FVQSVAITC

SEQ ID NO: 49094 - protein, 9 aa, Artificial Sequence
  Peptide Derived from Human Papillomavirus
YRFVQSVAI

SEQ ID NO: 49095 - protein, 9 aa, Artificial Sequence
  Peptide Derived from Human Papillomavirus
YDLQFIFQL

SEQ ID NO: 49096 - protein, 9 aa, Artificial Sequence
  Peptide Derived from Human Papillomavirus
IFLQMALWR

SEQ ID NO: 49097 - protein, 9 aa, Artificial Sequence
  Peptide Derived from Human Papillomavirus
VQLPDPNKF

SEQ ID NO: 49098 - protein, 9 aa, Artificial Sequence
  Peptide Derived from Human Papillomavirus
LHYHLLPLY

SEQ ID NO: 49099 - protein, 9 aa, Artificial Sequence
  Peptide Derived from Human Papillomavirus
VDTTPSTNL

SEQ ID NO: 49100 - protein, 9 aa, Artificial Sequence
  Peptide Derived from Human Papillomavirus
VHIIICGHY

SEQ ID NO: 49101 - protein, 9 aa, Artificial Sequence
  Peptide Derived from Human Papillomavirus
LKFWNVDLK

SEQ ID NO: 49102 - protein, 9 aa, Artificial Sequence
  Peptide Derived from Human Papillomavirus
MDFSTLQDT

SEQ ID NO: 49103 - protein, 9 aa, Artificial Sequence
  Peptide Derived from Human Papillomavirus
LYHPRPLPL

SEQ ID NO: 49104 - protein, 9 aa, Artificial Sequence
  Peptide Derived from Human Papillomavirus
LPLYGPLYH

SEQ ID NO: 49105 - protein, 9 aa, Artificial Sequence
  Peptide Derived from Human Papillomavirus
LFLRNVNVF

SEQ ID NO: 49106 - protein, 9 aa, Artificial Sequence
  Peptide Derived from Human Papillomavirus
LDDTESSHA

SEQ ID NO: 49107 - protein, 9 aa, Artificial Sequence
  Peptide Derived from Human Papillomavirus
YLQMSADPY

SEQ ID NO: 49108 - protein, 9 aa, Artificial Sequence
  Peptide Derived from Human Papillomavirus
VQSVAITCQ

SEQ ID NO: 49109 - protein, 9 aa, Artificial Sequence
  Peptide Derived from Human Papillomavirus
FRVQLPDPN

SEQ ID NO: 49110 - protein, 9 aa, Artificial Sequence
  Peptide Derived from Human Papillomavirus
MVSHRAARR

SEQ ID NO: 49111 - protein, 9 aa, Artificial Sequence
  Peptide Derived from Human Papillomavirus
VSHRAARRK

SEQ ID NO: 49112 - protein, 9 aa, Artificial Sequence
  Peptide Derived from Human Papillomavirus
MDPAVPVPS

SEQ ID NO: 49113 - protein, 9 aa, Artificial Sequence
  Peptide Derived from Human Papillomavirus
ILQWSSLGI

SEQ ID NO: 49114 - protein, 9 aa, Artificial Sequence
  Peptide Derived from Human Papillomavirus
VFVGTPTSG

SEQ ID NO: 49115 - protein, 9 aa, Artificial Sequence
  Peptide Derived from Human Papillomavirus
YSNVTVPLT

SEQ ID NO: 49116 - protein, 9 aa, Artificial Sequence
  Peptide Derived from Human Papillomavirus
FTRSGTQIG

SEQ ID NO: 49117 - protein, 9 aa, Artificial Sequence
  Peptide Derived from Human Papillomavirus
VPSRSTTSF

SEQ ID NO: 49118 - protein, 9 aa, Artificial Sequence
  Peptide Derived from Human Papillomavirus
LPSTTSVWP

SEQ ID NO: 49119 - protein, 9 aa, Artificial Sequence
  Peptide Derived from Human Papillomavirus
LQWSSLGIF

SEQ ID NO: 49120 - protein, 9 aa, Artificial Sequence
  Peptide Derived from Human Papillomavirus
LFDIYADDM

SEQ ID NO: 49121 - protein, 9 aa, Artificial Sequence
  Peptide Derived from Human Papillomavirus
VVTSGAPRP

SEQ ID NO: 49122 - protein, 9 aa, Artificial Sequence
  Peptide Derived from Human Papillomavirus
ISSTPLPTV

SEQ ID NO: 49123 - protein, 9 aa, Artificial Sequence
  Peptide Derived from Human Papillomavirus
LQTFASSGT

SEQ ID NO: 49124 - protein, 9 aa, Artificial Sequence
  Peptide Derived from Human Papillomavirus
FKYSPTISS

SEQ ID NO: 49125 - protein, 9 aa, Artificial Sequence
  Peptide Derived from Human Papillomavirus
VDTTLTFDP

SEQ ID NO: 49126 - protein, 9 aa, Artificial Sequence
  Peptide Derived from Human Papillomavirus
YSPTISSAS

SEQ ID NO: 49127 - protein, 9 aa, Artificial Sequence
  Peptide Derived from Human Papillomavirus
LGQRATMFT

SEQ ID NO: 49128 - protein, 9 aa, Artificial Sequence
  Peptide Derived from Human Papillomavirus
ITSAGTTTP

SEQ ID NO: 49129 - protein, 9 aa, Artificial Sequence
  Peptide Derived from Human Papillomavirus
LGGLGIGTG

SEQ ID NO: 49130 - protein, 9 aa, Artificial Sequence
  Peptide Derived from Human Papillomavirus
FVGTPTSGT

SEQ ID NO: 49131 - protein, 9 aa, Artificial Sequence
  Peptide Derived from Human Papillomavirus
ITLPSTTSV

SEQ ID NO: 49132 - protein, 9 aa, Artificial Sequence
  Peptide Derived from Human Papillomavirus
YYLWPLYYF

SEQ ID NO: 49133 - protein, 9 aa, Artificial Sequence
  Peptide Derived from Human Papillomavirus
LADKILQWS

SEQ ID NO: 49134 - protein, 9 aa, Artificial Sequence
  Peptide Derived from Human Papillomavirus
VGPTDPSIV

SEQ ID NO: 49135 - protein, 9 aa, Artificial Sequence
  Peptide Derived from Human Papillomavirus
LHRPALTSR

SEQ ID NO: 49136 - protein, 9 aa, Artificial Sequence
  Peptide Derived from Human Papillomavirus
WSSLGIFLG

SEQ ID NO: 49137 - protein, 9 aa, Artificial Sequence
  Peptide Derived from Human Papillomavirus
LIEDSSVVT

SEQ ID NO: 49138 - protein, 9 aa, Artificial Sequence
  Peptide Derived from Human Papillomavirus
IYADDMDPA

SEQ ID NO: 49139 - protein, 9 aa, Artificial Sequence
  Peptide Derived from Human Papillomavirus
FASSGTGEE

SEQ ID NO: 49140 - protein, 9 aa, Artificial Sequence
  Peptide Derived from Human Papillomavirus
LYYFIPKKR

SEQ ID NO: 49141 - protein, 9 aa, Artificial Sequence
  Peptide Derived from Human Papillomavirus
IRLHRPALT

SEQ ID NO: 49142 - protein, 9 aa, Artificial Sequence
  Peptide Derived from Human Papillomavirus
FEPVDTTLT

SEQ ID NO: 49143 - protein, 9 aa, Artificial Sequence
  Peptide Derived from Human Papillomavirus
FSDPSIIEV

SEQ ID NO: 49144 - protein, 9 aa, Artificial Sequence
  Peptide Derived from Human Papillomavirus
FLTRPSSLI

SEQ ID NO: 49145 - protein, 9 aa, Artificial Sequence
  Peptide Derived from Human Papillomavirus
VDVGPTRPP

SEQ ID NO: 49146 - protein, 9 aa, Artificial Sequence
  Peptide Derived from Human Papillomavirus
VGTPTSGTH

SEQ ID NO: 49147 - protein, 9 aa, Artificial Sequence
  Peptide Derived from Human Papillomavirus
VPLTSSWDV

SEQ ID NO: 49148 - protein, 9 aa, Artificial Sequence
  Peptide Derived from Human Papillomavirus
LDITPSSTS

SEQ ID NO: 49149 - protein, 9 aa, Artificial Sequence
  Peptide Derived from Human Papillomavirus
LTRPSSLIT

SEQ ID NO: 49150 - protein, 9 aa, Artificial Sequence
  Peptide Derived from Human Papillomavirus
IELQPLVSA

SEQ ID NO: 49151 - protein, 9 aa, Artificial Sequence
  Peptide Derived from Human Papillomavirus
IEVPQTGEV

SEQ ID NO: 49152 - protein, 9 aa, Artificial Sequence
  Peptide Derived from Human Papillomavirus
IEPVGPTDP

SEQ ID NO: 49153 - protein, 9 aa, Artificial Sequence
  Peptide Derived from Human Papillomavirus
VRFSRLGQR

SEQ ID NO: 49154 - protein, 9 aa, Artificial Sequence
  Peptide Derived from Human Papillomavirus
VPYFFADGF

SEQ ID NO: 49155 - protein, 9 aa, Artificial Sequence
  Peptide Derived from Human Papillomavirus
VVIEPVGPT

SEQ ID NO: 49156 - protein, 9 aa, Artificial Sequence
  Peptide Derived from Human Papillomavirus
FYHDISPIA

SEQ ID NO: 49157 - protein, 9 aa, Artificial Sequence
  Peptide Derived from Human Papillomavirus
MDIIRLHRP

SEQ ID NO: 49158 - protein, 9 aa, Artificial Sequence
  Peptide Derived from Human Papillomavirus
FFKYSPTIS

SEQ ID NO: 49159 - protein, 9 aa, Artificial Sequence
  Peptide Derived from Human Papillomavirus
IFLGGLGIG

SEQ ID NO: 49160 - protein, 9 aa, Artificial Sequence
  Peptide Derived from Human Papillomavirus
VVDVGPTRP

SEQ ID NO: 49161 - protein, 9 aa, Artificial Sequence
  Peptide Derived from Human Papillomavirus
YIELQPLVS

SEQ ID NO: 49162 - protein, 9 aa, Artificial Sequence
  Peptide Derived from Human Papillomavirus
ISSASSYSN

SEQ ID NO: 49163 - protein, 9 aa, Artificial Sequence
  Peptide Derived from Human Papillomavirus
YQQVSVANP

SEQ ID NO: 49164 - protein, 9 aa, Artificial Sequence
  Peptide Derived from Human Papillomavirus
ITYDNPAFE

SEQ ID NO: 49165 - protein, 9 aa, Artificial Sequence
  Peptide Derived from Human Papillomavirus
VTSGAPRPT

SEQ ID NO: 49166 - protein, 9 aa, Artificial Sequence
  Peptide Derived from Human Papillomavirus
VSISTTNFT

SEQ ID NO: 49167 - protein, 9 aa, Artificial Sequence
  Peptide Derived from Human Papillomavirus
YEEIPLQTF

SEQ ID NO: 49168 - protein, 9 aa, Artificial Sequence
  Peptide Derived from Human Papillomavirus
VLDITPSST

SEQ ID NO: 49169 - protein, 9 aa, Artificial Sequence
  Peptide Derived from Human Papillomavirus
IGIHGTHYY

SEQ ID NO: 49170 - protein, 9 aa, Artificial Sequence
  Peptide Derived from Human Papillomavirus
FDITSAGTT

SEQ ID NO: 49171 - protein, 9 aa, Artificial Sequence
  Peptide Derived from Human Papillomavirus
WPIVSPTAP

SEQ ID NO: 49172 - protein, 9 aa, Artificial Sequence
  Peptide Derived from Human Papillomavirus
VWPIVSPTA

SEQ ID NO: 49173 - protein, 9 aa, Artificial Sequence
  Peptide Derived from Human Papillomavirus
YHDISPIAP

SEQ ID NO: 49174 - protein, 9 aa, Artificial Sequence
  Peptide Derived from Human Papillomavirus
ITPSSTSVS

SEQ ID NO: 49175 - protein, 9 aa, Artificial Sequence
  Peptide Derived from Human Papillomavirus
VEGTTLADK

SEQ ID NO: 49176 - protein, 9 aa, Artificial Sequence
  Peptide Derived from Human Papillomavirus
YTGPDITLP

SEQ ID NO: 49177 - protein, 9 aa, Artificial Sequence
  Peptide Derived from Human Papillomavirus
VAGPRLYSR

SEQ ID NO: 49178 - protein, 9 aa, Artificial Sequence
  Peptide Derived from Human Papillomavirus
IEDSSVVTS

SEQ ID NO: 49179 - protein, 9 aa, Artificial Sequence
  Peptide Derived from Human Papillomavirus
VGPTRPPVV

SEQ ID NO: 49180 - protein, 9 aa, Artificial Sequence
  Peptide Derived from Human Papillomavirus
IVSPTAPAS

SEQ ID NO: 49181 - protein, 9 aa, Artificial Sequence
  Peptide Derived from Human Papillomavirus
VSPTAPAST

SEQ ID NO: 49182 - protein, 9 aa, Artificial Sequence
  Peptide Derived from Human Papillomavirus
ISPIAPSPE

SEQ ID NO: 49183 - protein, 9 aa, Artificial Sequence
  Peptide Derived from Human Papillomavirus
LQPLVSATE

SEQ ID NO: 49184 - protein, 9 aa, Artificial Sequence
  Peptide Derived from Human Papillomavirus
VSVANPEFL

SEQ ID NO: 49185 - protein, 9 aa, Artificial Sequence
  Peptide Derived from Human Papillomavirus
VTVPLTSSW

SEQ ID NO: 49186 - protein, 9 aa, Artificial Sequence
  Peptide Derived from Human Papillomavirus
LYWYRTGMS

SEQ ID NO: 49187 - protein, 9 aa, Artificial Sequence
  Peptide Derived from Human Papillomavirus
FLKSNSQAK

SEQ ID NO: 49188 - protein, 9 aa, Artificial Sequence
  Peptide Derived from Human Papillomavirus
WGMVMLMLV

SEQ ID NO: 49189 - protein, 9 aa, Artificial Sequence
  Peptide Derived from Human Papillomavirus
VTGTVAEGF

SEQ ID NO: 49190 - protein, 9 aa, Artificial Sequence
  Peptide Derived from Human Papillomavirus
VKDCGTMCR

SEQ ID NO: 49191 - protein, 9 aa, Artificial Sequence
  Peptide Derived from Human Papillomavirus
LFLKGVPKK

SEQ ID NO: 49192 - protein, 9 aa, Artificial Sequence
  Peptide Derived from Human Papillomavirus
WYRTGMSNI

SEQ ID NO: 49193 - protein, 9 aa, Artificial Sequence
  Peptide Derived from Human Papillomavirus
IQPPKLRST

SEQ ID NO: 49194 - protein, 9 aa, Artificial Sequence
  Peptide Derived from Human Papillomavirus
WFYVEAVID

SEQ ID NO: 49195 - protein, 9 aa, Artificial Sequence
  Peptide Derived from Human Papillomavirus
YIDNYLRNA

SEQ ID NO: 49196 - protein, 9 aa, Artificial Sequence
  Peptide Derived from Human Papillomavirus
WPYLHSRLV

SEQ ID NO: 49197 - protein, 9 aa, Artificial Sequence
  Peptide Derived from Human Papillomavirus
WKSFFSRTW

SEQ ID NO: 49198 - protein, 9 aa, Artificial Sequence
  Peptide Derived from Human Papillomavirus
IAYKYAQLA

SEQ ID NO: 49199 - protein, 9 aa, Artificial Sequence
  Peptide Derived from Human Papillomavirus
YGNTEVETQ

SEQ ID NO: 49200 - protein, 9 aa, Artificial Sequence
  Peptide Derived from Human Papillomavirus
FDLSQMVQW

SEQ ID NO: 49201 - protein, 9 aa, Artificial Sequence
  Peptide Derived from Human Papillomavirus
VAAFGVTGT

SEQ ID NO: 49202 - protein, 9 aa, Artificial Sequence
  Peptide Derived from Human Papillomavirus
YKYAQLADS

SEQ ID NO: 49203 - protein, 9 aa, Artificial Sequence
  Peptide Derived from Human Papillomavirus
LEKLLCIST

SEQ ID NO: 49204 - protein, 9 aa, Artificial Sequence
  Peptide Derived from Human Papillomavirus
VSGQNIRTL

SEQ ID NO: 49205 - protein, 9 aa, Artificial Sequence
  Peptide Derived from Human Papillomavirus
LLQPYCLYC

SEQ ID NO: 49206 - protein, 9 aa, Artificial Sequence
  Peptide Derived from Human Papillomavirus
ISYANSKSH

SEQ ID NO: 49207 - protein, 9 aa, Artificial Sequence
  Peptide Derived from Human Papillomavirus
FSTFKCVSG

SEQ ID NO: 49208 - protein, 9 aa, Artificial Sequence
  Peptide Derived from Human Papillomavirus
YFGMSLISF

SEQ ID NO: 49209 - protein, 9 aa, Artificial Sequence
  Peptide Derived from Human Papillomavirus
LSDISSCVD

SEQ ID NO: 49210 - protein, 9 aa, Artificial Sequence
  Peptide Derived from Human Papillomavirus
YVEAVIDRQ

SEQ ID NO: 49211 - protein, 9 aa, Artificial Sequence
  Peptide Derived from Human Papillomavirus
LMQLKCPPL

SEQ ID NO: 49212 - protein, 9 aa, Artificial Sequence
  Peptide Derived from Human Papillomavirus
YLRNALDGN

SEQ ID NO: 49213 - protein, 9 aa, Artificial Sequence
  Peptide Derived from Human Papillomavirus
VSFLSALKL

SEQ ID NO: 49214 - protein, 9 aa, Artificial Sequence
  Peptide Derived from Human Papillomavirus
LLEKLLCIS

SEQ ID NO: 49215 - protein, 9 aa, Artificial Sequence
  Peptide Derived from Human Papillomavirus
LDDATTPCW

SEQ ID NO: 49216 - protein, 9 aa, Artificial Sequence
  Peptide Derived from Human Papillomavirus
YANSKSHFW

SEQ ID NO: 49217 - protein, 9 aa, Artificial Sequence
  Peptide Derived from Human Papillomavirus
FQSNKSTCT

SEQ ID NO: 49218 - protein, 9 aa, Artificial Sequence
  Peptide Derived from Human Papillomavirus
VYGETPEWI

SEQ ID NO: 49219 - protein, 9 aa, Artificial Sequence
  Peptide Derived from Human Papillomavirus
LQGCIISYA

SEQ ID NO: 49220 - protein, 9 aa, Artificial Sequence
  Peptide Derived from Human Papillomavirus
MQLKCPPLL

SEQ ID NO: 49221 - protein, 9 aa, Artificial Sequence
  Peptide Derived from Human Papillomavirus
YGVSFMELI

SEQ ID NO: 49222 - protein, 9 aa, Artificial Sequence
  Peptide Derived from Human Papillomavirus
MLDDATTPC

SEQ ID NO: 49223 - protein, 9 aa, Artificial Sequence
  Peptide Derived from Human Papillomavirus
ILIHGAPNT

SEQ ID NO: 49224 - protein, 9 aa, Artificial Sequence
  Peptide Derived from Human Papillomavirus
ITIEKLLEK

SEQ ID NO: 49225 - protein, 9 aa, Artificial Sequence
  Peptide Derived from Human Papillomavirus
YVGSPLSDI

SEQ ID NO: 49226 - protein, 9 aa, Artificial Sequence
  Peptide Derived from Human Papillomavirus
FSRTWCRLN

SEQ ID NO: 49227 - protein, 9 aa, Artificial Sequence
  Peptide Derived from Human Papillomavirus
FWLQPLADA

SEQ ID NO: 49228 - protein, 9 aa, Artificial Sequence
  Peptide Derived from Human Papillomavirus
FGMSLISFL

SEQ ID NO: 49229 - protein, 9 aa, Artificial Sequence
  Peptide Derived from Human Papillomavirus
LQPYCLYCH

SEQ ID NO: 49230 - protein, 9 aa, Artificial Sequence
  Peptide Derived from Human Papillomavirus
LLCISTNCM

SEQ ID NO: 49231 - protein, 9 aa, Artificial Sequence
  Peptide Derived from Human Papillomavirus
FLQGCIISY

SEQ ID NO: 49232 - protein, 9 aa, Artificial Sequence
  Peptide Derived from Human Papillomavirus
VPKKNCILI

SEQ ID NO: 49233 - protein, 9 aa, Artificial Sequence
  Peptide Derived from Human Papillomavirus
FLKGVPKKN

SEQ ID NO: 49234 - protein, 9 aa, Artificial Sequence
  Peptide Derived from Human Papillomavirus
ISTNCMLIQ

SEQ ID NO: 49235 - protein, 9 aa, Artificial Sequence
  Peptide Derived from Human Papillomavirus
VRFKCAKNR

SEQ ID NO: 49236 - protein, 9 aa, Artificial Sequence
  Peptide Derived from Human Papillomavirus
LKCPPLLIT

SEQ ID NO: 49237 - protein, 9 aa, Artificial Sequence
  Peptide Derived from Human Papillomavirus
LADAKIGML

SEQ ID NO: 49238 - protein, 9 aa, Artificial Sequence
  Peptide Derived from Human Papillomavirus
FTFPNPFPF

SEQ ID NO: 49239 - protein, 9 aa, Artificial Sequence
  Peptide Derived from Human Papillomavirus
VSFMELIRP

SEQ ID NO: 49240 - protein, 9 aa, Artificial Sequence
  Peptide Derived from Human Papillomavirus
YRTGMSNIS

SEQ ID NO: 49241 - protein, 9 aa, Artificial Sequence
  Peptide Derived from Human Papillomavirus
IRPFQSNKS

SEQ ID NO: 49242 - protein, 9 aa, Artificial Sequence
  Peptide Derived from Human Papillomavirus
WIKSRCDKV

SEQ ID NO: 49243 - protein, 9 aa, Artificial Sequence
  Peptide Derived from Human Papillomavirus
LVRFKCAKN

SEQ ID NO: 49244 - protein, 9 aa, Artificial Sequence
  Peptide Derived from Human Papillomavirus
VEEQQTTLS

SEQ ID NO: 49245 - protein, 9 aa, Artificial Sequence
  Peptide Derived from Human Papillomavirus
LIHGAPNTG

SEQ ID NO: 49246 - protein, 9 aa, Artificial Sequence
  Peptide Derived from Human Papillomavirus
VYNNQAEAE

SEQ ID NO: 49247 - protein, 9 aa, Artificial Sequence
  Peptide Derived from Human Papillomavirus
MDDSEIAYK

SEQ ID NO: 49248 - protein, 9 aa, Artificial Sequence
  Peptide Derived from Human Papillomavirus
FYVEAVIDR

SEQ ID NO: 49249 - protein, 9 aa, Artificial Sequence
  Peptide Derived from Human Papillomavirus
VETQQMVQV

SEQ ID NO: 49250 - protein, 9 aa, Artificial Sequence
  Peptide Derived from Human Papillomavirus
IERQTVLQH

SEQ ID NO: 49251 - protein, 9 aa, Artificial Sequence
  Peptide Derived from Human Papillomavirus
LRSTAAALY

SEQ ID NO: 49252 - protein, 9 aa, Artificial Sequence
  Peptide Derived from Human Papillomavirus
LITSNINAG

SEQ ID NO: 49253 - protein, 9 aa, Artificial Sequence
  Peptide Derived from Human Papillomavirus
FHAQEAEEH

SEQ ID NO: 49254 - protein, 9 aa, Artificial Sequence
  Peptide Derived from Human Papillomavirus
FVSFLSALK

SEQ ID NO: 49255 - protein, 9 aa, Artificial Sequence
  Peptide Derived from Human Papillomavirus
LSCNGSDGT

SEQ ID NO: 49256 - protein, 9 aa, Artificial Sequence
  Peptide Derived from Human Papillomavirus
YDNDVMDDS

SEQ ID NO: 49257 - protein, 9 aa, Artificial Sequence
  Peptide Derived from Human Papillomavirus
VGSPLSDIS

SEQ ID NO: 49258 - protein, 9 aa, Artificial Sequence
  Peptide Derived from Human Papillomavirus
LDGNPVSID

SEQ ID NO: 49259 - protein, 9 aa, Artificial Sequence
  Peptide Derived from Human Papillomavirus
LQVLKTSNG

SEQ ID NO: 49260 - protein, 9 aa, Artificial Sequence
  Peptide Derived from Human Papillomavirus
FELPDSGYG

SEQ ID NO: 49261 - protein, 9 aa, Artificial Sequence
  Peptide Derived from Human Papillomavirus
YLHSRLVVF

SEQ ID NO: 49262 - protein, 9 aa, Artificial Sequence
  Peptide Derived from Human Papillomavirus
WLQPLADAK

SEQ ID NO: 49263 - protein, 9 aa, Artificial Sequence
  Peptide Derived from Human Papillomavirus
VKHKALMQL

SEQ ID NO: 49264 - protein, 9 aa, Artificial Sequence
  Peptide Derived from Human Papillomavirus
LKAICIENN

SEQ ID NO: 49265 - protein, 9 aa, Artificial Sequence
  Peptide Derived from Human Papillomavirus
VVFTFPNPF

SEQ ID NO: 49266 - protein, 9 aa, Artificial Sequence
  Peptide Derived from Human Papillomavirus
WCRLNLHEE

SEQ ID NO: 49267 - protein, 9 aa, Artificial Sequence
  Peptide Derived from Human Papillomavirus
VDYNISPRL

SEQ ID NO: 49268 - protein, 9 aa, Artificial Sequence
  Peptide Derived from Human Papillomavirus
MVMLMLVRF

SEQ ID NO: 49269 - protein, 9 aa, Artificial Sequence
  Peptide Derived from Human Papillomavirus
MLIQPPKLR

SEQ ID NO: 49270 - protein, 9 aa, Artificial Sequence
  Peptide Derived from Human Papillomavirus
WIERQTVLQ

SEQ ID NO: 49271 - protein, 9 aa, Artificial Sequence
  Peptide Derived from Human Papillomavirus
FGVTGTVAE

SEQ ID NO: 49272 - protein, 9 aa, Artificial Sequence
  Peptide Derived from Human Papillomavirus
IDNCNVYNN

SEQ ID NO: 49273 - protein, 9 aa, Artificial Sequence
  Peptide Derived from Human Papillomavirus
VIDRQTGDN

SEQ ID NO: 49274 - protein, 9 aa, Artificial Sequence
  Peptide Derived from Human Papillomavirus
FPNPFPFDK

SEQ ID NO: 49275 - protein, 9 aa, Artificial Sequence
  Peptide Derived from Human Papillomavirus
LRYQQIEFV

SEQ ID NO: 49276 - protein, 9 aa, Artificial Sequence
  Peptide Derived from Human Papillomavirus
LKRKYVGSP

SEQ ID NO: 49277 - protein, 9 aa, Artificial Sequence
  Peptide Derived from Human Papillomavirus
LSALKLFLK

SEQ ID NO: 49278 - protein, 9 aa, Artificial Sequence
  Peptide Derived from Human Papillomavirus
MELIRPFQS

SEQ ID NO: 49279 - protein, 9 aa, Artificial Sequence
  Peptide Derived from Human Papillomavirus
VMLMLVRFK

SEQ ID NO: 49280 - protein, 9 aa, Artificial Sequence
  Peptide Derived from Human Papillomavirus
LHSRLVVFT

SEQ ID NO: 49281 - protein, 9 aa, Artificial Sequence
  Peptide Derived from Human Papillomavirus
LADSDSNAC

SEQ ID NO: 49282 - protein, 9 aa, Artificial Sequence
  Peptide Derived from Human Papillomavirus
LQSLACSWG

SEQ ID NO: 49283 - protein, 9 aa, Artificial Sequence
  Peptide Derived from Human Papillomavirus
YCHLQSLAC

SEQ ID NO: 49284 - protein, 9 aa, Artificial Sequence
  Peptide Derived from Human Papillomavirus
VTKLPTANN

SEQ ID NO: 49285 - protein, 9 aa, Artificial Sequence
  Peptide Derived from Human Papillomavirus
LQAIELQMM

SEQ ID NO: 49286 - protein, 9 aa, Artificial Sequence
  Peptide Derived from Human Papillomavirus
VSKAKALQA

SEQ ID NO: 49287 - protein, 9 aa, Artificial Sequence
  Peptide Derived from Human Papillomavirus
MGIHSINHQ

SEQ ID NO: 49288 - protein, 9 aa, Artificial Sequence
  Peptide Derived from Human Papillomavirus
ISAAACTNQ

SEQ ID NO: 49289 - protein, 9 aa, Artificial Sequence
  Peptide Derived from Human Papillomavirus
LNTVKIPNT

SEQ ID NO: 49290 - protein, 9 aa, Artificial Sequence
  Peptide Derived from Human Papillomavirus
MQQTSLELY

SEQ ID NO: 49291 - protein, 9 aa, Artificial Sequence
  Peptide Derived from Human Papillomavirus
VNCKGIYYV

SEQ ID NO: 49292 - protein, 9 aa, Artificial Sequence
  Peptide Derived from Human Papillomavirus
FAGIVTKLP

SEQ ID NO: 49293 - protein, 9 aa, Artificial Sequence
  Peptide Derived from Human Papillomavirus
MMLETLNNT

SEQ ID NO: 49294 - protein, 9 aa, Artificial Sequence
  Peptide Derived from Human Papillomavirus
FSSDEISFA

SEQ ID NO: 49295 - protein, 9 aa, Artificial Sequence
  Peptide Derived from Human Papillomavirus
IVTKLPTAN

SEQ ID NO: 49296 - protein, 9 aa, Artificial Sequence
  Peptide Derived from Human Papillomavirus
VDSVNCGVI

SEQ ID NO: 49297 - protein, 9 aa, Artificial Sequence
  Peptide Derived from Human Papillomavirus
IVFPESVFS

SEQ ID NO: 49298 - protein, 9 aa, Artificial Sequence
  Peptide Derived from Human Papillomavirus
LECVLMYKA

SEQ ID NO: 49299 - protein, 9 aa, Artificial Sequence
  Peptide Derived from Human Papillomavirus
YFVNFTEEA

SEQ ID NO: 49300 - protein, 9 aa, Artificial Sequence
  Peptide Derived from Human Papillomavirus
VPALSVSKA

SEQ ID NO: 49301 - protein, 9 aa, Artificial Sequence
  Peptide Derived from Human Papillomavirus
WKHIRLECV

SEQ ID NO: 49302 - protein, 9 aa, Artificial Sequence
  Peptide Derived from Human Papillomavirus
INHQVVPAL

SEQ ID NO: 49303 - protein, 9 aa, Artificial Sequence
  Peptide Derived from Human Papillomavirus
LTYISTSQR

SEQ ID NO: 49304 - protein, 9 aa, Artificial Sequence
  Peptide Derived from Human Papillomavirus
VHEGHITYF

SEQ ID NO: 49305 - protein, 9 aa, Artificial Sequence
  Peptide Derived from Human Papillomavirus
YEQVSSTWH

SEQ ID NO: 49306 - protein, 9 aa, Artificial Sequence
  Peptide Derived from Human Papillomavirus
VLMYKAREM

SEQ ID NO: 49307 - protein, 9 aa, Artificial Sequence
  Peptide Derived from Human Papillomavirus
YLTAPTGCL

SEQ ID NO: 49308 - protein, 9 aa, Artificial Sequence
  Peptide Derived from Human Papillomavirus
LRYRLSKYK

SEQ ID NO: 49309 - protein, 9 aa, Artificial Sequence
  Peptide Derived from Human Papillomavirus
VKIPNTVSV

SEQ ID NO: 49310 - protein, 9 aa, Artificial Sequence
  Peptide Derived from Human Papillomavirus
IELQMMLET

SEQ ID NO: 49311 - protein, 9 aa, Artificial Sequence
  Peptide Derived from Human Papillomavirus
VTLTYISTS

SEQ ID NO: 49312 - protein, 9 aa, Artificial Sequence
  Peptide Derived from Human Papillomavirus
VISAAACTN

SEQ ID NO: 49313 - protein, 9 aa, Artificial Sequence
  Peptide Derived from Human Papillomavirus
WTMQQTSLE

SEQ ID NO: 49314 - protein, 9 aa, Artificial Sequence
  Peptide Derived from Human Papillomavirus
VVPALSVSK

SEQ ID NO: 49315 - protein, 9 aa, Artificial Sequence
  Peptide Derived from Human Papillomavirus
LRGDSVDSV

SEQ ID NO: 49316 - protein, 9 aa, Artificial Sequence
  Peptide Derived from Human Papillomavirus
FIYLCIDGQ

SEQ ID NO: 49317 - protein, 9 aa, Artificial Sequence
  Peptide Derived from Human Papillomavirus
LLRGDSVDS

SEQ ID NO: 49318 - protein, 9 aa, Artificial Sequence
  Peptide Derived from Human Papillomavirus
VVEGQVNCK

SEQ ID NO: 49319 - protein, 9 aa, Artificial Sequence
  Peptide Derived from Human Papillomavirus
LELYLTAPT

SEQ ID NO: 49320 - protein, 9 aa, Artificial Sequence
  Peptide Derived from Human Papillomavirus
VFPESVFSS

SEQ ID NO: 49321 - protein, 9 aa, Artificial Sequence
  Peptide Derived from Human Papillomavirus
VCQDKILEH

SEQ ID NO: 49322 - protein, 9 aa, Artificial Sequence
  Peptide Derived from Human Papillomavirus
ISFAGIVTK

SEQ ID NO: 49323 - protein, 9 aa, Artificial Sequence
  Peptide Derived from Human Papillomavirus
VRRATTSTK

SEQ ID NO: 49324 - protein, 9 aa, Artificial Sequence
  Peptide Derived from Human Papillomavirus
LYLTAPTGC

SEQ ID NO: 49325 - protein, 9 aa, Artificial Sequence
  Peptide Derived from Human Papillomavirus
WHWTCTDGK

SEQ ID NO: 49326 - protein, 9 aa, Artificial Sequence
  Peptide Derived from Human Papillomavirus
VSCPATTPI

SEQ ID NO: 49327 - protein, 9 aa, Artificial Sequence
  Peptide Derived from Human Papillomavirus
IPNTVSVST

SEQ ID NO: 49328 - protein, 9 aa, Artificial Sequence
  Peptide Derived from Human Papillomavirus
VNCGVISAA

SEQ ID NO: 49329 - protein, 9 aa, Artificial Sequence
  Peptide Derived from Human Papillomavirus
YKAREMGIH

SEQ ID NO: 49330 - protein, 9 aa, Artificial Sequence
  Peptide Derived from Human Papillomavirus
LSVSKAKAL

SEQ ID NO: 49331 - protein, 9 aa, Artificial Sequence
  Peptide Derived from Human Papillomavirus
IRLECVLMY

SEQ ID NO: 49332 - protein, 9 aa, Artificial Sequence
  Peptide Derived from Human Papillomavirus
LYEQVSSTW

SEQ ID NO: 49333 - protein, 9 aa, Artificial Sequence
  Peptide Derived from Human Papillomavirus
IDGQCTVVE

SEQ ID NO: 49334 - protein, 9 aa, Artificial Sequence
  Peptide Derived from Human Papillomavirus
WKFIYLCID

SEQ ID NO: 49335 - protein, 9 aa, Artificial Sequence
  Peptide Derived from Human Papillomavirus
MIELNISTV

SEQ ID NO: 49336 - protein, 9 aa, Artificial Sequence
  Peptide Derived from Human Papillomavirus
IELNISTVS

SEQ ID NO: 49337 - protein, 9 aa, Artificial Sequence
  Peptide Derived from Human Papillomavirus
LLLIVILWV

SEQ ID NO: 49338 - protein, 9 aa, Artificial Sequence
  Peptide Derived from Human Papillomavirus
IYVVFIYIP

SEQ ID NO: 49339 - protein, 9 aa, Artificial Sequence
  Peptide Derived from Human Papillomavirus
VLLFVCLVI

SEQ ID NO: 49340 - protein, 9 aa, Artificial Sequence
  Peptide Derived from Human Papillomavirus
LCFCVLLFV

SEQ ID NO: 49341 - protein, 9 aa, Artificial Sequence
  Peptide Derived from Human Papillomavirus
VVFIYIPLF

SEQ ID NO: 49342 - protein, 9 aa, Artificial Sequence
  Peptide Derived from Human Papillomavirus
IRPLVLSVS

SEQ ID NO: 49343 - protein, 9 aa, Artificial Sequence
  Peptide Derived from Human Papillomavirus
LFVCLVIRP

SEQ ID NO: 49344 - protein, 9 aa, Artificial Sequence
  Peptide Derived from Human Papillomavirus
ISTVSIVLC

SEQ ID NO: 49345 - protein, 9 aa, Artificial Sequence
  Peptide Derived from Human Papillomavirus
LLFVCLVIR

SEQ ID NO: 49346 - protein, 9 aa, Artificial Sequence
  Peptide Derived from Human Papillomavirus
IPLFVIHTH

SEQ ID NO: 49347 - protein, 9 aa, Artificial Sequence
  Peptide Derived from Human Papillomavirus
LVIRPLVLS

SEQ ID NO: 49348 - protein, 9 aa, Artificial Sequence
  Peptide Derived from Human Papillomavirus
VIATSPLRC

SEQ ID NO: 49349 - protein, 9 aa, Artificial Sequence
  Peptide Derived from Human Papillomavirus
LVLSVSVYA

SEQ ID NO: 49350 - protein, 9 aa, Artificial Sequence
  Peptide Derived from Human Papillomavirus
VSIVLCFLL

SEQ ID NO: 49351 - protein, 9 aa, Artificial Sequence
  Peptide Derived from Human Papillomavirus
LWVIATSPL

SEQ ID NO: 49352 - protein, 9 aa, Artificial Sequence
  Peptide Derived from Human Papillomavirus
VFIYIPLFV

SEQ ID NO: 49353 - protein, 9 aa, Artificial Sequence
  Peptide Derived from Human Papillomavirus
LLCFCVLLF

SEQ ID NO: 49354 - protein, 9 aa, Artificial Sequence
  Peptide Derived from Human Papillomavirus
IHTHASFLS

SEQ ID NO: 49355 - protein, 9 aa, Artificial Sequence
  Peptide Derived from Human Papillomavirus
ILWVIATSP

SEQ ID NO: 49356 - protein, 9 aa, Artificial Sequence
  Peptide Derived from Human Papillomavirus
VILWVIATS

SEQ ID NO: 49357 - protein, 9 aa, Artificial Sequence
  Peptide Derived from Human Papillomavirus
IVILWVIAT

SEQ ID NO: 49358 - protein, 9 aa, Artificial Sequence
  Peptide Derived from Human Papillomavirus
FCIYVVFIY

SEQ ID NO: 49359 - protein, 9 aa, Artificial Sequence
  Peptide Derived from Human Papillomavirus
IATSPLRCF

SEQ ID NO: 49360 - protein, 9 aa, Artificial Sequence
  Peptide Derived from Human Papillomavirus
LNISTVSIV

SEQ ID NO: 49361 - protein, 9 aa, Artificial Sequence
  Peptide Derived from Human Papillomavirus
VIHTHASFL

SEQ ID NO: 49362 - protein, 9 aa, Artificial Sequence
  Peptide Derived from Human Papillomavirus
VLSVSVYAT

SEQ ID NO: 49363 - protein, 9 aa, Artificial Sequence
  Peptide Derived from Human Papillomavirus
LCFLLCFCV

SEQ ID NO: 49364 - protein, 9 aa, Artificial Sequence
  Peptide Derived from Human Papillomavirus
VYATLLLLI

SEQ ID NO: 49365 - protein, 9 aa, Artificial Sequence
  Peptide Derived from Human Papillomavirus
LLIVILWVI

SEQ ID NO: 49366 - protein, 9 aa, Artificial Sequence
  Peptide Derived from Human Papillomavirus
LRCFCIYVV

SEQ ID NO: 49367 - protein, 9 aa, Artificial Sequence
  Peptide Derived from Human Papillomavirus
IVLCFLLCF

SEQ ID NO: 49368 - protein, 9 aa, Artificial Sequence
  Peptide Derived from Human Papillomavirus
VIRPLVLSV

SEQ ID NO: 49369 - protein, 9 aa, Artificial Sequence
  Peptide Derived from Human Papillomavirus
YIPLFVIHT

SEQ ID NO: 49370 - protein, 9 aa, Artificial Sequence
  Peptide Derived from Human Papillomavirus
WVIATSPLR

SEQ ID NO: 49371 - protein, 9 aa, Artificial Sequence
  Peptide Derived from Human Papillomavirus
FLLCFCVLL

SEQ ID NO: 49372 - protein, 9 aa, Artificial Sequence
  Peptide Derived from Human Papillomavirus
FVCLVIRPL

SEQ ID NO: 49373 - protein, 9 aa, Artificial Sequence
  Peptide Derived from Human Papillomavirus
VSVYATLLL

SEQ ID NO: 49374 - protein, 9 aa, Artificial Sequence
  Peptide Derived from Human Papillomavirus
VLCFLLCFC

SEQ ID NO: 49375 - protein, 9 aa, Artificial Sequence
  Peptide Derived from Human Papillomavirus
YATLLLLIV

SEQ ID NO: 49376 - protein, 9 aa, Artificial Sequence
  Peptide Derived from Human Papillomavirus
LLLLIVILW

SEQ ID NO: 49377 - protein, 9 aa, Artificial Sequence
  Peptide Derived from Human Papillomavirus
LFVIHTHAS

SEQ ID NO: 49378 - protein, 9 aa, Artificial Sequence
  Peptide Derived from Human Papillomavirus
FIYIPLFVI

SEQ ID NO: 49379 - protein, 9 aa, Artificial Sequence
  Peptide Derived from Human Papillomavirus
MFKNPAERP

SEQ ID NO: 49380 - protein, 9 aa, Artificial Sequence
  Peptide Derived from Human Papillomavirus
IPYDELRLN

SEQ ID NO: 49381 - protein, 9 aa, Artificial Sequence
  Peptide Derived from Human Papillomavirus
LIRCITCQR

SEQ ID NO: 49382 - protein, 9 aa, Artificial Sequence
  Peptide Derived from Human Papillomavirus
FYSKVSEFR

SEQ ID NO: 49383 - protein, 9 aa, Artificial Sequence
  Peptide Derived from Human Papillomavirus
FTDLTIVYR

SEQ ID NO: 49384 - protein, 9 aa, Artificial Sequence
  Peptide Derived from Human Papillomavirus
IRCITCQRP

SEQ ID NO: 49385 - protein, 9 aa, Artificial Sequence
  Peptide Derived from Human Papillomavirus
WYRYSVYGT

SEQ ID NO: 49386 - protein, 9 aa, Artificial Sequence
  Peptide Derived from Human Papillomavirus
YDELRLNCV

SEQ ID NO: 49387 - protein, 9 aa, Artificial Sequence
  Peptide Derived from Human Papillomavirus
LNCVYCKGQ

SEQ ID NO: 49388 - protein, 9 aa, Artificial Sequence
  Peptide Derived from Human Papillomavirus
IGGRWTGRC

SEQ ID NO: 49389 - protein, 9 aa, Artificial Sequence
  Peptide Derived from Human Papillomavirus
WTGRCIACW

SEQ ID NO: 49390 - protein, 9 aa, Artificial Sequence
  Peptide Derived from Human Papillomavirus
WRRPRTETQ

SEQ ID NO: 49391 - protein, 9 aa, Artificial Sequence
  Peptide Derived from Human Papillomavirus
LLIRCITCQ

SEQ ID NO: 49392 - protein, 9 aa, Artificial Sequence
  Peptide Derived from Human Papillomavirus
ITCQRPLCP

SEQ ID NO: 49393 - protein, 9 aa, Artificial Sequence
  Peptide Derived from Human Papillomavirus
LTETEVLDF

SEQ ID NO: 49394 - protein, 9 aa, Artificial Sequence
  Peptide Derived from Human Papillomavirus
LTNKGICDL

SEQ ID NO: 49395 - protein, 9 aa, Artificial Sequence
  Peptide Derived from Human Papillomavirus
VYRDDTPHG

SEQ ID NO: 49396 - protein, 9 aa, Artificial Sequence
  Peptide Derived from Human Papillomavirus
YCKGQLTET

SEQ ID NO: 49397 - protein, 9 aa, Artificial Sequence
  Peptide Derived from Human Papillomavirus
ICDLLIRCI

SEQ ID NO: 49398 - protein, 9 aa, Artificial Sequence
  Peptide Derived from Human Papillomavirus
VCTKCLRFY

SEQ ID NO: 49399 - protein, 9 aa, Artificial Sequence
  Peptide Derived from Human Papillomavirus
LHELSSALE

SEQ ID NO: 49400 - protein, 9 aa, Artificial Sequence
  Peptide Derived from Human Papillomavirus
VYGTTLEKL

SEQ ID NO: 49401 - protein, 9 aa, Artificial Sequence
  Peptide Derived from Human Papillomavirus
LDFAFTDLT

SEQ ID NO: 49402 - protein, 9 aa, Artificial Sequence
  Peptide Derived from Human Papillomavirus
YRDDTPHGV

SEQ ID NO: 49403 - protein, 9 aa, Artificial Sequence
  Peptide Derived from Human Papillomavirus
FAFTDLTIV

SEQ ID NO: 49404 - protein, 9 aa, Artificial Sequence
  Peptide Derived from Human Papillomavirus
YSVYGTTLE

SEQ ID NO: 49405 - protein, 9 aa, Artificial Sequence
  Peptide Derived from Human Papillomavirus
LRLNCVYCK

SEQ ID NO: 49406 - protein, 9 aa, Artificial Sequence
  Peptide Derived from Human Papillomavirus
MRGETPTLQ

SEQ ID NO: 49407 - protein, 9 aa, Artificial Sequence
  Peptide Derived from Human Papillomavirus
ILQELLMGS

SEQ ID NO: 49408 - protein, 9 aa, Artificial Sequence
  Peptide Derived from Human Papillomavirus
VIDSPAGQA

SEQ ID NO: 49409 - protein, 9 aa, Artificial Sequence
  Peptide Derived from Human Papillomavirus
MGSFGIVCP

SEQ ID NO: 49410 - protein, 9 aa, Artificial Sequence
  Peptide Derived from Human Papillomavirus
VCPNCSTRL

SEQ ID NO: 49411 - protein, 9 aa, Artificial Sequence
  Peptide Derived from Human Papillomavirus
LQELLMGSF

SEQ ID NO: 49412 - protein, 9 aa, Artificial Sequence
  Peptide Derived from Human Papillomavirus
FGIVCPNCS

SEQ ID NO: 49413 - protein, 9 aa, Artificial Sequence
  Peptide Derived from Human Papillomavirus
IVTFCCQCK

SEQ ID NO: 49414 - protein, 9 aa, Artificial Sequence
  Peptide Derived from Human Papillomavirus
VLDLQPEAT

SEQ ID NO: 49415 - protein, 9 aa, Artificial Sequence
  Peptide Derived from Human Papillomavirus
VQSTQVDIR

SEQ ID NO: 49416 - protein, 9 aa, Artificial Sequence
  Peptide Derived from Human Papillomavirus
IVCPNCSTR

SEQ ID NO: 49417 - protein, 9 aa, Artificial Sequence
  Peptide Derived from Human Papillomavirus
VDIRILQEL

SEQ ID NO: 49418 - protein, 9 aa, Artificial Sequence
  Peptide Derived from Human Papillomavirus
LCVQSTQVD

SEQ ID NO: 49419 - protein, 9 aa, Artificial Sequence
  Peptide Derived from Human Papillomavirus
LQDYVLDLQ

SEQ ID NO: 49420 - protein, 9 aa, Artificial Sequence
  Peptide Derived from Human Papillomavirus
LQPEATDLH

SEQ ID NO: 49421 - protein, 9 aa, Artificial Sequence
  Peptide Derived from Human Papillomavirus
MSLWRPSEA

SEQ ID NO: 49422 - protein, 9 aa, Artificial Sequence
  Peptide Derived from Human Papillomavirus
MTYIHSMNP

SEQ ID NO: 49423 - protein, 9 aa, Artificial Sequence
  Peptide Derived from Human Papillomavirus
LTVGHPYYS

SEQ ID NO: 49424 - protein, 9 aa, Artificial Sequence
  Peptide Derived from Human Papillomavirus
YLPPVPVSK

SEQ ID NO: 49425 - protein, 9 aa, Artificial Sequence
  Peptide Derived from Human Papillomavirus
IANSDTTFK

SEQ ID NO: 49426 - protein, 9 aa, Artificial Sequence
  Peptide Derived from Human Papillomavirus
MDYKQTQLC

SEQ ID NO: 49427 - protein, 9 aa, Artificial Sequence
  Peptide Derived from Human Papillomavirus
LELKNSVIQ

SEQ ID NO: 49428 - protein, 9 aa, Artificial Sequence
  Peptide Derived from Human Papillomavirus
VTRTNIYYH

SEQ ID NO: 49429 - protein, 9 aa, Artificial Sequence
  Peptide Derived from Human Papillomavirus
FIFQLCKIT

SEQ ID NO: 49430 - protein, 9 aa, Artificial Sequence
  Peptide Derived from Human Papillomavirus
IKGSGSTAT

SEQ ID NO: 49431 - protein, 9 aa, Artificial Sequence
  Peptide Derived from Human Papillomavirus
FYNPETQRL

SEQ ID NO: 49432 - protein, 9 aa, Artificial Sequence
  Peptide Derived from Human Papillomavirus
FGLTTPPSG

SEQ ID NO: 49433 - protein, 9 aa, Artificial Sequence
  Peptide Derived from Human Papillomavirus
FWEVNLKEK

SEQ ID NO: 49434 - protein, 9 aa, Artificial Sequence
  Peptide Derived from Human Papillomavirus
VYLPPVPVS

SEQ ID NO: 49435 - protein, 9 aa, Artificial Sequence
  Peptide Derived from Human Papillomavirus
YRFVTSQAI

SEQ ID NO: 49436 - protein, 9 aa, Artificial Sequence
  Peptide Derived from Human Papillomavirus
LKEKFSADL

SEQ ID NO: 49437 - protein, 9 aa, Artificial Sequence
  Peptide Derived from Human Papillomavirus
LRREQMFVR

SEQ ID NO: 49438 - protein, 9 aa, Artificial Sequence
  Peptide Derived from Human Papillomavirus
MDFTALQDT

SEQ ID NO: 49439 - protein, 9 aa, Artificial Sequence
  Peptide Derived from Human Papillomavirus
YVFWEVNLK

SEQ ID NO: 49440 - protein, 9 aa, Artificial Sequence
  Peptide Derived from Human Papillomavirus
LQDTKSNVP

SEQ ID NO: 49441 - protein, 9 aa, Artificial Sequence
  Peptide Derived from Human Papillomavirus
FDLQFIFQL

SEQ ID NO: 49442 - protein, 9 aa, Artificial Sequence
  Peptide Derived from Human Papillomavirus
WGKGSPCSN

SEQ ID NO: 49443 - protein, 9 aa, Artificial Sequence
  Peptide Derived from Human Papillomavirus
VGRGQPLGV

SEQ ID NO: 49444 - protein, 9 aa, Artificial Sequence
  Peptide Derived from Human Papillomavirus
YRVFRVRLP

SEQ ID NO: 49445 - protein, 9 aa, Artificial Sequence
  Peptide Derived from Human Papillomavirus
LFVTVVDTT

SEQ ID NO: 49446 - protein, 9 aa, Artificial Sequence
  Peptide Derived from Human Papillomavirus
LGVGISGHP

SEQ ID NO: 49447 - protein, 9 aa, Artificial Sequence
  Peptide Derived from Human Papillomavirus
ISGHPLLNK

SEQ ID NO: 49448 - protein, 9 aa, Artificial Sequence
  Peptide Derived from Human Papillomavirus
YSIPKSDNP

SEQ ID NO: 49449 - protein, 9 aa, Artificial Sequence
  Peptide Derived from Human Papillomavirus
LCKITLSAD

SEQ ID NO: 49450 - protein, 9 aa, Artificial Sequence
  Peptide Derived from Human Papillomavirus
MNPAILEDW

SEQ ID NO: 49451 - protein, 9 aa, Artificial Sequence
  Peptide Derived from Human Papillomavirus
LSADIMTYI

SEQ ID NO: 49452 - protein, 9 aa, Artificial Sequence
  Peptide Derived from Human Papillomavirus
VVPKVSGLQ

SEQ ID NO: 49453 - protein, 9 aa, Artificial Sequence
  Peptide Derived from Human Papillomavirus
VPLDICNSI

SEQ ID NO: 49454 - protein, 9 aa, Artificial Sequence
  Peptide Derived from Human Papillomavirus
LGCKPPIGE

SEQ ID NO: 49455 - protein, 9 aa, Artificial Sequence
  Peptide Derived from Human Papillomavirus
WNFGLTTPP

SEQ ID NO: 49456 - protein, 9 aa, Artificial Sequence
  Peptide Derived from Human Papillomavirus
VPVSKVVST

SEQ ID NO: 49457 - protein, 9 aa, Artificial Sequence
  Peptide Derived from Human Papillomavirus
WRPSEATVY

SEQ ID NO: 49458 - protein, 9 aa, Artificial Sequence
  Peptide Derived from Human Papillomavirus
IHSMNPAIL

SEQ ID NO: 49459 - protein, 9 aa, Artificial Sequence
  Peptide Derived from Human Papillomavirus
LTTPPSGSL

SEQ ID NO: 49460 - protein, 9 aa, Artificial Sequence
  Peptide Derived from Human Papillomavirus
YHAGSARLL

SEQ ID NO: 49461 - protein, 9 aa, Artificial Sequence
  Peptide Derived from Human Papillomavirus
YWMQRAQGH

SEQ ID NO: 49462 - protein, 9 aa, Artificial Sequence
  Peptide Derived from Human Papillomavirus
VCAAIANSD

SEQ ID NO: 49463 - protein, 9 aa, Artificial Sequence
  Peptide Derived from Human Papillomavirus
ITPGDCPPL

SEQ ID NO: 49464 - protein, 9 aa, Artificial Sequence
  Peptide Derived from Human Papillomavirus
YFPTPSGSM

SEQ ID NO: 49465 - protein, 9 aa, Artificial Sequence
  Peptide Derived from Human Papillomavirus
IQDGDMVDT

SEQ ID NO: 49466 - protein, 9 aa, Artificial Sequence
  Peptide Derived from Human Papillomavirus
LDICNSICK

SEQ ID NO: 49467 - protein, 9 aa, Artificial Sequence
  Peptide Derived from Human Papillomavirus
IVVPKVSGL

SEQ ID NO: 49468 - protein, 9 aa, Artificial Sequence
  Peptide Derived from Human Papillomavirus
ICNSICKYP

SEQ ID NO: 49469 - protein, 9 aa, Artificial Sequence
  Peptide Derived from Human Papillomavirus
LKNSVIQDG

SEQ ID NO: 49470 - protein, 9 aa, Artificial Sequence
  Peptide Derived from Human Papillomavirus
FGFPDTSFY

SEQ ID NO: 49471 - protein, 9 aa, Artificial Sequence
  Peptide Derived from Human Papillomavirus
LYIKGSGST

SEQ ID NO: 49472 - protein, 9 aa, Artificial Sequence
  Peptide Derived from Human Papillomavirus
VSKVVSTDE

SEQ ID NO: 49473 - protein, 9 aa, Artificial Sequence
  Peptide Derived from Human Papillomavirus
FQLCKITLS

SEQ ID NO: 49474 - protein, 9 aa, Artificial Sequence
  Peptide Derived from Human Papillomavirus
LGRKFLLQA

SEQ ID NO: 49475 - protein, 9 aa, Artificial Sequence
  Peptide Derived from Human Papillomavirus
LLGCKPPIG

SEQ ID NO: 49476 - protein, 9 aa, Artificial Sequence
  Peptide Derived from Human Papillomavirus
VTVVDTTRS

SEQ ID NO: 49477 - protein, 9 aa, Artificial Sequence
  Peptide Derived from Human Papillomavirus
LCLLGCKPP

SEQ ID NO: 49478 - protein, 9 aa, Artificial Sequence
  Peptide Derived from Human Papillomavirus
VFRVRLPDP

SEQ ID NO: 49479 - protein, 9 aa, Artificial Sequence
  Peptide Derived from Human Papillomavirus
FNRSGTVGE

SEQ ID NO: 49480 - protein, 9 aa, Artificial Sequence
  Peptide Derived from Human Papillomavirus
WACVGLEVG

SEQ ID NO: 49481 - protein, 9 aa, Artificial Sequence
  Peptide Derived from Human Papillomavirus
LDQFPLGRK

SEQ ID NO: 49482 - protein, 9 aa, Artificial Sequence
  Peptide Derived from Human Papillomavirus
MVTSDAQIF

SEQ ID NO: 49483 - protein, 9 aa, Artificial Sequence
  Peptide Derived from Human Papillomavirus
VGESVPTDL

SEQ ID NO: 49484 - protein, 9 aa, Artificial Sequence
  Peptide Derived from Human Papillomavirus
YKQTQLCLL

SEQ ID NO: 49485 - protein, 9 aa, Artificial Sequence
  Peptide Derived from Human Papillomavirus
ITCQKTAPQ

SEQ ID NO: 49486 - protein, 9 aa, Artificial Sequence
  Peptide Derived from Human Papillomavirus
MSVCAAIAN

SEQ ID NO: 49487 - protein, 9 aa, Artificial Sequence
  Peptide Derived from Human Papillomavirus
YYHAGSARL

SEQ ID NO: 49488 - protein, 9 aa, Artificial Sequence
  Peptide Derived from Human Papillomavirus
LVWACVGLE

SEQ ID NO: 49489 - protein, 9 aa, Artificial Sequence
  Peptide Derived from Human Papillomavirus
LPPVPVSKV

SEQ ID NO: 49490 - protein, 9 aa, Artificial Sequence
  Peptide Derived from Human Papillomavirus
FVTSQAITC

SEQ ID NO: 49491 - protein, 9 aa, Artificial Sequence
  Peptide Derived from Human Papillomavirus
VRLPDPNKF

SEQ ID NO: 49492 - protein, 9 aa, Artificial Sequence
  Peptide Derived from Human Papillomavirus
VDTTRSTNM

SEQ ID NO: 49493 - protein, 9 aa, Artificial Sequence
  Peptide Derived from Human Papillomavirus
YLKMVAEPY

SEQ ID NO: 49494 - protein, 9 aa, Artificial Sequence
  Peptide Derived from Human Papillomavirus
VTSQAITCQ

SEQ ID NO: 49495 - protein, 9 aa, Artificial Sequence
  Peptide Derived from Human Papillomavirus
FRVRLPDPN

SEQ ID NO: 49496 - protein, 9 aa, Artificial Sequence
  Peptide Derived from Human Papillomavirus
MRSKRSTKR

SEQ ID NO: 49497 - protein, 9 aa, Artificial Sequence
  Peptide Derived from Human Papillomavirus
ILRYGSMGV

SEQ ID NO: 49498 - protein, 9 aa, Artificial Sequence
  Peptide Derived from Human Papillomavirus
VDTPATHNV

SEQ ID NO: 49499 - protein, 9 aa, Artificial Sequence
  Peptide Derived from Human Papillomavirus
FLDIIALHR

SEQ ID NO: 49500 - protein, 9 aa, Artificial Sequence
  Peptide Derived from Human Papillomavirus
VLQPPTPAE

SEQ ID NO: 49501 - protein, 9 aa, Artificial Sequence
  Peptide Derived from Human Papillomavirus
LRYGSMGVF

SEQ ID NO: 49502 - protein, 9 aa, Artificial Sequence
  Peptide Derived from Human Papillomavirus
FTVDTPATH

SEQ ID NO: 49503 - protein, 9 aa, Artificial Sequence
  Peptide Derived from Human Papillomavirus
IEHAPTQVF

SEQ ID NO: 49504 - protein, 9 aa, Artificial Sequence
  Peptide Derived from Human Papillomavirus
IPIRPPVSI

SEQ ID NO: 49505 - protein, 9 aa, Artificial Sequence
  Peptide Derived from Human Papillomavirus
LYFSNTSHN

SEQ ID NO: 49506 - protein, 9 aa, Artificial Sequence
  Peptide Derived from Human Papillomavirus
MDTFIVSTN

SEQ ID NO: 49507 - protein, 9 aa, Artificial Sequence
  Peptide Derived from Human Papillomavirus
IVDVGAPAP

SEQ ID NO: 49508 - protein, 9 aa, Artificial Sequence
  Peptide Derived from Human Papillomavirus
YFSNTSHNI

SEQ ID NO: 49509 - protein, 9 aa, Artificial Sequence
  Peptide Derived from Human Papillomavirus
IEMQPLGAS

SEQ ID NO: 49510 - protein, 9 aa, Artificial Sequence
  Peptide Derived from Human Papillomavirus
FYLHPSYYM

SEQ ID NO: 49511 - protein, 9 aa, Artificial Sequence
  Peptide Derived from Human Papillomavirus
LLSSSSIST

SEQ ID NO: 49512 - protein, 9 aa, Artificial Sequence
  Peptide Derived from Human Papillomavirus
VPIEHAPTQ

SEQ ID NO: 49513 - protein, 9 aa, Artificial Sequence
  Peptide Derived from Human Papillomavirus
FGGLGIGSG

SEQ ID NO: 49514 - protein, 9 aa, Artificial Sequence
  Peptide Derived from Human Papillomavirus
LSSSSISTH

SEQ ID NO: 49515 - protein, 9 aa, Artificial Sequence
  Peptide Derived from Human Papillomavirus
IADQILRYG

SEQ ID NO: 49516 - protein, 9 aa, Artificial Sequence
  Peptide Derived from Human Papillomavirus
YDISSINPA

SEQ ID NO: 49517 - protein, 9 aa, Artificial Sequence
  Peptide Derived from Human Papillomavirus
VGPLDPSIV

SEQ ID NO: 49518 - protein, 9 aa, Artificial Sequence
  Peptide Derived from Human Papillomavirus
LHRPALTSR

SEQ ID NO: 49519 - protein, 9 aa, Artificial Sequence
  Peptide Derived from Human Papillomavirus
VTSVSTHEN

SEQ ID NO: 49520 - protein, 9 aa, Artificial Sequence
  Peptide Derived from Human Papillomavirus
YGSMGVFFG

SEQ ID NO: 49521 - protein, 9 aa, Artificial Sequence
  Peptide Derived from Human Papillomavirus
FSGPDVPIE

SEQ ID NO: 49522 - protein, 9 aa, Artificial Sequence
  Peptide Derived from Human Papillomavirus
IEHTTIADQ

SEQ ID NO: 49523 - protein, 9 aa, Artificial Sequence
  Peptide Derived from Human Papillomavirus
VGAPAPIPH

SEQ ID NO: 49524 - protein, 9 aa, Artificial Sequence
  Peptide Derived from Human Papillomavirus
ITYENPAYE

SEQ ID NO: 49525 - protein, 9 aa, Artificial Sequence
  Peptide Derived from Human Papillomavirus
IALHRPALT

SEQ ID NO: 49526 - protein, 9 aa, Artificial Sequence
  Peptide Derived from Human Papillomavirus
LGASATTTS

SEQ ID NO: 49527 - protein, 9 aa, Artificial Sequence
  Peptide Derived from Human Papillomavirus
LYDIYADTD

SEQ ID NO: 49528 - protein, 9 aa, Artificial Sequence
  Peptide Derived from Human Papillomavirus
ITSSTPIPG

SEQ ID NO: 49529 - protein, 9 aa, Artificial Sequence
  Peptide Derived from Human Papillomavirus
YETVNAEES

SEQ ID NO: 49530 - protein, 9 aa, Artificial Sequence
  Peptide Derived from Human Papillomavirus
FTDPSVLQP

SEQ ID NO: 49531 - protein, 9 aa, Artificial Sequence
  Peptide Derived from Human Papillomavirus
LDVTSVSTH

SEQ ID NO: 49532 - protein, 9 aa, Artificial Sequence
  Peptide Derived from Human Papillomavirus
IPHPPTTSG

SEQ ID NO: 49533 - protein, 9 aa, Artificial Sequence
  Peptide Derived from Human Papillomavirus
LDIIALHRP

SEQ ID NO: 49534 - protein, 9 aa, Artificial Sequence
  Peptide Derived from Human Papillomavirus
LAPTTPQVS

SEQ ID NO: 49535 - protein, 9 aa, Artificial Sequence
  Peptide Derived from Human Papillomavirus
VSEASIPIR

SEQ ID NO: 49536 - protein, 9 aa, Artificial Sequence
  Peptide Derived from Human Papillomavirus
LQPPTPAET

SEQ ID NO: 49537 - protein, 9 aa, Artificial Sequence
  Peptide Derived from Human Papillomavirus
VFPFPLAPT

SEQ ID NO: 49538 - protein, 9 aa, Artificial Sequence
  Peptide Derived from Human Papillomavirus
IDPVGPLDP

SEQ ID NO: 49539 - protein, 9 aa, Artificial Sequence
  Peptide Derived from Human Papillomavirus
VSYFFTDVS

SEQ ID NO: 49540 - protein, 9 aa, Artificial Sequence
  Peptide Derived from Human Papillomavirus
LYSKATQQV

SEQ ID NO: 49541 - protein, 9 aa, Artificial Sequence
  Peptide Derived from Human Papillomavirus
VRYSRLGNK

SEQ ID NO: 49542 - protein, 9 aa, Artificial Sequence
  Peptide Derived from Human Papillomavirus
VSIDPVGPL

SEQ ID NO: 49543 - protein, 9 aa, Artificial Sequence
  Peptide Derived from Human Papillomavirus
YVPLSTRPS

SEQ ID NO: 49544 - protein, 9 aa, Artificial Sequence
  Peptide Derived from Human Papillomavirus
YYYDISSIN

SEQ ID NO: 49545 - protein, 9 aa, Artificial Sequence
  Peptide Derived from Human Papillomavirus
YFFTDVSVA

SEQ ID NO: 49546 - protein, 9 aa, Artificial Sequence
  Peptide Derived from Human Papillomavirus
VPTNTTVPL

SEQ ID NO: 49547 - protein, 9 aa, Artificial Sequence
  Peptide Derived from Human Papillomavirus
LLLSSSSIS

SEQ ID NO: 49548 - protein, 9 aa, Artificial Sequence
  Peptide Derived from Human Papillomavirus
VDVGAPAPI

SEQ ID NO: 49549 - protein, 9 aa, Artificial Sequence
  Peptide Derived from Human Papillomavirus
MQPLGASAT

SEQ ID NO: 49550 - protein, 9 aa, Artificial Sequence
  Peptide Derived from Human Papillomavirus
IRPPVSIDP

SEQ ID NO: 49551 - protein, 9 aa, Artificial Sequence
  Peptide Derived from Human Papillomavirus
VFFGGLGIG

SEQ ID NO: 49552 - protein, 9 aa, Artificial Sequence
  Peptide Derived from Human Papillomavirus
VQSTSAVSA

SEQ ID NO: 49553 - protein, 9 aa, Artificial Sequence
  Peptide Derived from Human Papillomavirus
VSPSTAVQS

SEQ ID NO: 49554 - protein, 9 aa, Artificial Sequence
  Peptide Derived from Human Papillomavirus
YEEIPMDTF

SEQ ID NO: 49555 - protein, 9 aa, Artificial Sequence
  Peptide Derived from Human Papillomavirus
ILDVTSVST

SEQ ID NO: 49556 - protein, 9 aa, Artificial Sequence
  Peptide Derived from Human Papillomavirus
YQTCKAAGT

SEQ ID NO: 49557 - protein, 9 aa, Artificial Sequence
  Peptide Derived from Human Papillomavirus
VKVIDPTFL

SEQ ID NO: 49558 - protein, 9 aa, Artificial Sequence
  Peptide Derived from Human Papillomavirus
FPFPLAPTT

SEQ ID NO: 49559 - protein, 9 aa, Artificial Sequence
  Peptide Derived from Human Papillomavirus
VSAYVPTNT

SEQ ID NO: 49560 - protein, 9 aa, Artificial Sequence
  Peptide Derived from Human Papillomavirus
FDIATTADT

SEQ ID NO: 49561 - protein, 9 aa, Artificial Sequence
  Peptide Derived from Human Papillomavirus
FPLAPTTPQ

SEQ ID NO: 49562 - protein, 9 aa, Artificial Sequence
  Peptide Derived from Human Papillomavirus
LDPSIVSLV

SEQ ID NO: 49563 - protein, 9 aa, Artificial Sequence
  Peptide Derived from Human Papillomavirus
YYDISSINP

SEQ ID NO: 49564 - protein, 9 aa, Artificial Sequence
  Peptide Derived from Human Papillomavirus
IDPTFLSAP

SEQ ID NO: 49565 - protein, 9 aa, Artificial Sequence
  Peptide Derived from Human Papillomavirus
YVPTNTTVP

SEQ ID NO: 49566 - protein, 9 aa, Artificial Sequence
  Peptide Derived from Human Papillomavirus
VEESGIVDV

SEQ ID NO: 49567 - protein, 9 aa, Artificial Sequence
  Peptide Derived from Human Papillomavirus
FFTDVSVAA

SEQ ID NO: 49568 - protein, 9 aa, Artificial Sequence
  Peptide Derived from Human Papillomavirus
VNAEESLYF

SEQ ID NO: 49569 - protein, 9 aa, Artificial Sequence
  Peptide Derived from Human Papillomavirus
LGNKQTLRT

SEQ ID NO: 49570 - protein, 9 aa, Artificial Sequence
  Peptide Derived from Human Papillomavirus
LSTRPSTVS

SEQ ID NO: 49571 - protein, 9 aa, Artificial Sequence
  Peptide Derived from Human Papillomavirus
ISSINPAGE

SEQ ID NO: 49572 - protein, 9 aa, Artificial Sequence
  Peptide Derived from Human Papillomavirus
FLKSNSQAK

SEQ ID NO: 49573 - protein, 9 aa, Artificial Sequence
  Peptide Derived from Human Papillomavirus
VVDRAANPC

SEQ ID NO: 49574 - protein, 9 aa, Artificial Sequence
  Peptide Derived from Human Papillomavirus
VKDCGIMCR

SEQ ID NO: 49575 - protein, 9 aa, Artificial Sequence
  Peptide Derived from Human Papillomavirus
MSNLLSIPE

SEQ ID NO: 49576 - protein, 9 aa, Artificial Sequence
  Peptide Derived from Human Papillomavirus
WFRTAMSNI

SEQ ID NO: 49577 - protein, 9 aa, Artificial Sequence
  Peptide Derived from Human Papillomavirus
ISFMELVRP

SEQ ID NO: 49578 - protein, 9 aa, Artificial Sequence
  Peptide Derived from Human Papillomavirus
YWFRTAMSN

SEQ ID NO: 49579 - protein, 9 aa, Artificial Sequence
  Peptide Derived from Human Papillomavirus
VTLQEISNV

SEQ ID NO: 49580 - protein, 9 aa, Artificial Sequence
  Peptide Derived from Human Papillomavirus
IEPPKLRSQ

SEQ ID NO: 49581 - protein, 9 aa, Artificial Sequence
  Peptide Derived from Human Papillomavirus
WFEVEAVIE

SEQ ID NO: 49582 - protein, 9 aa, Artificial Sequence
  Peptide Derived from Human Papillomavirus
WKSFFSRTW

SEQ ID NO: 49583 - protein, 9 aa, Artificial Sequence
  Peptide Derived from Human Papillomavirus
YYYAQLADS

SEQ ID NO: 49584 - protein, 9 aa, Artificial Sequence
  Peptide Derived from Human Papillomavirus
FDLSEMVQW

SEQ ID NO: 49585 - protein, 9 aa, Artificial Sequence
  Peptide Derived from Human Papillomavirus
IIILLLIRF

SEQ ID NO: 49586 - protein, 9 aa, Artificial Sequence
  Peptide Derived from Human Papillomavirus
IAYYYAQLA

SEQ ID NO: 49587 - protein, 9 aa, Artificial Sequence
  Peptide Derived from Human Papillomavirus
YGNTEVETQ

SEQ ID NO: 49588 - protein, 9 aa, Artificial Sequence
  Peptide Derived from Human Papillomavirus
WPYLHSRLT

SEQ ID NO: 49589 - protein, 9 aa, Artificial Sequence
  Peptide Derived from Human Papillomavirus
LNDLESSGV

SEQ ID NO: 49590 - protein, 9 aa, Artificial Sequence
  Peptide Derived from Human Papillomavirus
ITGYGISPS

SEQ ID NO: 49591 - protein, 9 aa, Artificial Sequence
  Peptide Derived from Human Papillomavirus
YRKRKIDEL

SEQ ID NO: 49592 - protein, 9 aa, Artificial Sequence
  Peptide Derived from Human Papillomavirus
LNAVCALKR

SEQ ID NO: 49593 - protein, 9 aa, Artificial Sequence
  Peptide Derived from Human Papillomavirus
MVIEPPKLR

SEQ ID NO: 49594 - protein, 9 aa, Artificial Sequence
  Peptide Derived from Human Papillomavirus
FLKGIPKKS

SEQ ID NO: 49595 - protein, 9 aa, Artificial Sequence
  Peptide Derived from Human Papillomavirus
ISCVNSKSH

SEQ ID NO: 49596 - protein, 9 aa, Artificial Sequence
  Peptide Derived from Human Papillomavirus
ISTFKCSAG

SEQ ID NO: 49597 - protein, 9 aa, Artificial Sequence
  Peptide Derived from Human Papillomavirus
YFGMSLIQF

SEQ ID NO: 49598 - protein, 9 aa, Artificial Sequence
  Peptide Derived from Human Papillomavirus
ISPSVAESL

SEQ ID NO: 49599 - protein, 9 aa, Artificial Sequence
  Peptide Derived from Human Papillomavirus
LVQLKCPPL

SEQ ID NO: 49600 - protein, 9 aa, Artificial Sequence
  Peptide Derived from Human Papillomavirus
YTHLQCLTC

SEQ ID NO: 49601 - protein, 9 aa, Artificial Sequence
  Peptide Derived from Human Papillomavirus
YYAQLADSN

SEQ ID NO: 49602 - protein, 9 aa, Artificial Sequence
  Peptide Derived from Human Papillomavirus
YMRNALDGN

SEQ ID NO: 49603 - protein, 9 aa, Artificial Sequence
  Peptide Derived from Human Papillomavirus
IDDVTPISW

SEQ ID NO: 49604 - protein, 9 aa, Artificial Sequence
  Peptide Derived from Human Papillomavirus
WIQSRCEKT

SEQ ID NO: 49605 - protein, 9 aa, Artificial Sequence
  Peptide Derived from Human Papillomavirus
LIRFRCSKN

SEQ ID NO: 49606 - protein, 9 aa, Artificial Sequence
  Peptide Derived from Human Papillomavirus
LKGCVISCV

SEQ ID NO: 49607 - protein, 9 aa, Artificial Sequence
  Peptide Derived from Human Papillomavirus
VQGTTPEWI

SEQ ID NO: 49608 - protein, 9 aa, Artificial Sequence
  Peptide Derived from Human Papillomavirus
MELVRPFKS

SEQ ID NO: 49609 - protein, 9 aa, Artificial Sequence
  Peptide Derived from Human Papillomavirus
YGISPSVAE

SEQ ID NO: 49610 - protein, 9 aa, Artificial Sequence
  Peptide Derived from Human Papillomavirus
YGISFMELV

SEQ ID NO: 49611 - protein, 9 aa, Artificial Sequence
  Peptide Derived from Human Papillomavirus
MIDDVTPIS

SEQ ID NO: 49612 - protein, 9 aa, Artificial Sequence
  Peptide Derived from Human Papillomavirus
LTVAKLMSN

SEQ ID NO: 49613 - protein, 9 aa, Artificial Sequence
  Peptide Derived from Human Papillomavirus
MLICGPANT

SEQ ID NO: 49614 - protein, 9 aa, Artificial Sequence
  Peptide Derived from Human Papillomavirus
FSRTWCKLD

SEQ ID NO: 49615 - protein, 9 aa, Artificial Sequence
  Peptide Derived from Human Papillomavirus
FWLQPLSDA

SEQ ID NO: 49616 - protein, 9 aa, Artificial Sequence
  Peptide Derived from Human Papillomavirus
FGMSLIQFL

SEQ ID NO: 49617 - protein, 9 aa, Artificial Sequence
  Peptide Derived from Human Papillomavirus
IKQHSLYTH

SEQ ID NO: 49618 - protein, 9 aa, Artificial Sequence
  Peptide Derived from Human Papillomavirus
FLKGCVISC

SEQ ID NO: 49619 - protein, 9 aa, Artificial Sequence
  Peptide Derived from Human Papillomavirus
IPKKSCMLI

SEQ ID NO: 49620 - protein, 9 aa, Artificial Sequence
  Peptide Derived from Human Papillomavirus
LIKQHSLYT

SEQ ID NO: 49621 - protein, 9 aa, Artificial Sequence
  Peptide Derived from Human Papillomavirus
FIDDSMENS

SEQ ID NO: 49622 - protein, 9 aa, Artificial Sequence
  Peptide Derived from Human Papillomavirus
IRFRCSKNR

SEQ ID NO: 49623 - protein, 9 aa, Artificial Sequence
  Peptide Derived from Human Papillomavirus
IPETCMVIE

SEQ ID NO: 49624 - protein, 9 aa, Artificial Sequence
  Peptide Derived from Human Papillomavirus
LESSGVGDD

SEQ ID NO: 49625 - protein, 9 aa, Artificial Sequence
  Peptide Derived from Human Papillomavirus
LSDAKIGMI

SEQ ID NO: 49626 - protein, 9 aa, Artificial Sequence
  Peptide Derived from Human Papillomavirus
FEFKNPFPF

SEQ ID NO: 49627 - protein, 9 aa, Artificial Sequence
  Peptide Derived from Human Papillomavirus
LKCPPLLLT

SEQ ID NO: 49628 - protein, 9 aa, Artificial Sequence
  Peptide Derived from Human Papillomavirus
FRTAMSNIS

SEQ ID NO: 49629 - protein, 9 aa, Artificial Sequence
  Peptide Derived from Human Papillomavirus
VRPFKSDKT

SEQ ID NO: 49630 - protein, 9 aa, Artificial Sequence
  Peptide Derived from Human Papillomavirus
YKFKEAYGI

SEQ ID NO: 49631 - protein, 9 aa, Artificial Sequence
  Peptide Derived from Human Papillomavirus
VETQQMVQQ

SEQ ID NO: 49632 - protein, 9 aa, Artificial Sequence
  Peptide Derived from Human Papillomavirus
IDRLTVLQH

SEQ ID NO: 49633 - protein, 9 aa, Artificial Sequence
  Peptide Derived from Human Papillomavirus
LRSQTCALY

SEQ ID NO: 49634 - protein, 9 aa, Artificial Sequence
  Peptide Derived from Human Papillomavirus
LLTSNTNAG

SEQ ID NO: 49635 - protein, 9 aa, Artificial Sequence
  Peptide Derived from Human Papillomavirus
VQQVESQNG

SEQ ID NO: 49636 - protein, 9 aa, Artificial Sequence
  Peptide Derived from Human Papillomavirus
YDNELTDDS

SEQ ID NO: 49637 - protein, 9 aa, Artificial Sequence
  Peptide Derived from Human Papillomavirus
VQLKCPPLL

SEQ ID NO: 49638 - protein, 9 aa, Artificial Sequence
  Peptide Derived from Human Papillomavirus
IILLLIRFR

SEQ ID NO: 49639 - protein, 9 aa, Artificial Sequence
  Peptide Derived from Human Papillomavirus
VAKLMSNLL

SEQ ID NO: 49640 - protein, 9 aa, Artificial Sequence
  Peptide Derived from Human Papillomavirus
LDGNEISID

SEQ ID NO: 49641 - protein, 9 aa, Artificial Sequence
  Peptide Derived from Human Papillomavirus
YLHSRLTVF

SEQ ID NO: 49642 - protein, 9 aa, Artificial Sequence
  Peptide Derived from Human Papillomavirus
LICGPANTG

SEQ ID NO: 49643 - protein, 9 aa, Artificial Sequence
  Peptide Derived from Human Papillomavirus
WLQPLSDAK

SEQ ID NO: 49644 - protein, 9 aa, Artificial Sequence
  Peptide Derived from Human Papillomavirus
VKHRALVQL

SEQ ID NO: 49645 - protein, 9 aa, Artificial Sequence
  Peptide Derived from Human Papillomavirus
LSIPETCMV

SEQ ID NO: 49646 - protein, 9 aa, Artificial Sequence
  Peptide Derived from Human Papillomavirus
LHSSNTKAN

SEQ ID NO: 49647 - protein, 9 aa, Artificial Sequence
  Peptide Derived from Human Papillomavirus
WCKLDLIEE

SEQ ID NO: 49648 - protein, 9 aa, Artificial Sequence
  Peptide Derived from Human Papillomavirus
YIDDYMRNA

SEQ ID NO: 49649 - protein, 9 aa, Artificial Sequence
  Peptide Derived from Human Papillomavirus
LYWFRTAMS

SEQ ID NO: 49650 - protein, 9 aa, Artificial Sequence
  Peptide Derived from Human Papillomavirus
FEVEAVIER

SEQ ID NO: 49651 - protein, 9 aa, Artificial Sequence
  Peptide Derived from Human Papillomavirus
WIDRLTVLQ

SEQ ID NO: 49652 - protein, 9 aa, Artificial Sequence
  Peptide Derived from Human Papillomavirus
LMSNLLSIP

SEQ ID NO: 49653 - protein, 9 aa, Artificial Sequence
  Peptide Derived from Human Papillomavirus
LKRKFAACS

SEQ ID NO: 49654 - protein, 9 aa, Artificial Sequence
  Peptide Derived from Human Papillomavirus
VIERRTGDN

SEQ ID NO: 49655 - protein, 9 aa, Artificial Sequence
  Peptide Derived from Human Papillomavirus
FKNPFPFDE

SEQ ID NO: 49656 - protein, 9 aa, Artificial Sequence
  Peptide Derived from Human Papillomavirus
LRYQNIEFT

SEQ ID NO: 49657 - protein, 9 aa, Artificial Sequence
  Peptide Derived from Human Papillomavirus
FKSDKTSCT

SEQ ID NO: 49658 - protein, 9 aa, Artificial Sequence
  Peptide Derived from Human Papillomavirus
ISWTYIDDY

SEQ ID NO: 49659 - protein, 9 aa, Artificial Sequence
  Peptide Derived from Human Papillomavirus
LHSRLTVFE

SEQ ID NO: 49660 - protein, 9 aa, Artificial Sequence
  Peptide Derived from Human Papillomavirus
LADSNSNAA

SEQ ID NO: 49661 - protein, 9 aa, Artificial Sequence
  Peptide Derived from Human Papillomavirus
LQCLTCDRG

SEQ ID NO: 49662 - protein, 9 aa, Artificial Sequence
  Peptide Derived from Human Papillomavirus
MEEISARLN

SEQ ID NO: 49663 - protein, 9 aa, Artificial Sequence
  Peptide Derived from Human Papillomavirus
YSKTQMWEV

SEQ ID NO: 49664 - protein, 9 aa, Artificial Sequence
  Peptide Derived from Human Papillomavirus
VIELQMALE

SEQ ID NO: 49665 - protein, 9 aa, Artificial Sequence
  Peptide Derived from Human Papillomavirus
MGFSHLCHQ

SEQ ID NO: 49666 - protein, 9 aa, Artificial Sequence
  Peptide Derived from Human Papillomavirus
YTAKQMGFS

SEQ ID NO: 49667 - protein, 9 aa, Artificial Sequence
  Peptide Derived from Human Papillomavirus
LTKLFCADP

SEQ ID NO: 49668 - protein, 9 aa, Artificial Sequence
  Peptide Derived from Human Papillomavirus
VVPSLLASK

SEQ ID NO: 49669 - protein, 9 aa, Artificial Sequence
  Peptide Derived from Human Papillomavirus
LDNRTARTA

SEQ ID NO: 49670 - protein, 9 aa, Artificial Sequence
  Peptide Derived from Human Papillomavirus
IIEEDTCTM

SEQ ID NO: 49671 - protein, 9 aa, Artificial Sequence
  Peptide Derived from Human Papillomavirus
LDLYEADKT

SEQ ID NO: 49672 - protein, 9 aa, Artificial Sequence
  Peptide Derived from Human Papillomavirus
MALETLSKS

SEQ ID NO: 49673 - protein, 9 aa, Artificial Sequence
  Peptide Derived from Human Papillomavirus
VGGQVIVCP

SEQ ID NO: 49674 - protein, 9 aa, Artificial Sequence
  Peptide Derived from Human Papillomavirus
FKEDAAKYS

SEQ ID NO: 49675 - protein, 9 aa, Artificial Sequence
  Peptide Derived from Human Papillomavirus
IELQMALET

SEQ ID NO: 49676 - protein, 9 aa, Artificial Sequence
  Peptide Derived from Human Papillomavirus
LCHQVVPSL

SEQ ID NO: 49677 - protein, 9 aa, Artificial Sequence
  Peptide Derived from Human Papillomavirus
VIVCPTSIS

SEQ ID NO: 49678 - protein, 9 aa, Artificial Sequence
  Peptide Derived from Human Papillomavirus
IVCPTSISS

SEQ ID NO: 49679 - protein, 9 aa, Artificial Sequence
  Peptide Derived from Human Papillomavirus
VPSLLASKT

SEQ ID NO: 49680 - protein, 9 aa, Artificial Sequence
  Peptide Derived from Human Papillomavirus
LIRMECALL

SEQ ID NO: 49681 - protein, 9 aa, Artificial Sequence
  Peptide Derived from Human Papillomavirus
WKLIRMECA

SEQ ID NO: 49682 - protein, 9 aa, Artificial Sequence
  Peptide Derived from Human Papillomavirus
YYIHNCEKV

SEQ ID NO: 49683 - protein, 9 aa, Artificial Sequence
  Peptide Derived from Human Papillomavirus
IEEDTCTMV

SEQ ID NO: 49684 - protein, 9 aa, Artificial Sequence
  Peptide Derived from Human Papillomavirus
YSSMSSTWH

SEQ ID NO: 49685 - protein, 9 aa, Artificial Sequence
  Peptide Derived from Human Papillomavirus
MWEVHVGGQ

SEQ ID NO: 49686 - protein, 9 aa, Artificial Sequence
  Peptide Derived from Human Papillomavirus
YEADKTDLP

SEQ ID NO: 49687 - protein, 9 aa, Artificial Sequence
  Peptide Derived from Human Papillomavirus
WLCEPPKCF

SEQ ID NO: 49688 - protein, 9 aa, Artificial Sequence
  Peptide Derived from Human Papillomavirus
VKIPPTVQI

SEQ ID NO: 49689 - protein, 9 aa, Artificial Sequence
  Peptide Derived from Human Papillomavirus
MECALLYTA

SEQ ID NO: 49690 - protein, 9 aa, Artificial Sequence
  Peptide Derived from Human Papillomavirus
YKELYSSMS

SEQ ID NO: 49691 - protein, 9 aa, Artificial Sequence
  Peptide Derived from Human Papillomavirus
VQEKILDLY

SEQ ID NO: 49692 - protein, 9 aa, Artificial Sequence
  Peptide Derived from Human Papillomavirus
LFCADPALD

SEQ ID NO: 49693 - protein, 9 aa, Artificial Sequence
  Peptide Derived from Human Papillomavirus
VTVTFVTEQ

SEQ ID NO: 49694 - protein, 9 aa, Artificial Sequence
  Peptide Derived from Human Papillomavirus
IEHWKLIRM

SEQ ID NO: 49695 - protein, 9 aa, Artificial Sequence
  Peptide Derived from Human Papillomavirus
ISSNQISTT

SEQ ID NO: 49696 - protein, 9 aa, Artificial Sequence
  Peptide Derived from Human Papillomavirus
LGTVKIPPT

SEQ ID NO: 49697 - protein, 9 aa, Artificial Sequence
  Peptide Derived from Human Papillomavirus
MFLGTVKIP

SEQ ID NO: 49698 - protein, 9 aa, Artificial Sequence
  Peptide Derived from Human Papillomavirus
VCSSNVAPI

SEQ ID NO: 49699 - protein, 9 aa, Artificial Sequence
  Peptide Derived from Human Papillomavirus
LEVWLCEPP

SEQ ID NO: 49700 - protein, 9 aa, Artificial Sequence
  Peptide Derived from Human Papillomavirus
VCPTSISSN

SEQ ID NO: 49701 - protein, 9 aa, Artificial Sequence
  Peptide Derived from Human Papillomavirus
LQQTSLEVW

SEQ ID NO: 49702 - protein, 9 aa, Artificial Sequence
  Peptide Derived from Human Papillomavirus
VWLCEPPKC

SEQ ID NO: 49703 - protein, 9 aa, Artificial Sequence
  Peptide Derived from Human Papillomavirus
ISTTETADI

SEQ ID NO: 49704 - protein, 9 aa, Artificial Sequence
  Peptide Derived from Human Papillomavirus
MVTGKVDYI

SEQ ID NO: 49705 - protein, 9 aa, Artificial Sequence
  Peptide Derived from Human Papillomavirus
VDYIGMYYI

SEQ ID NO: 49706 - protein, 9 aa, Artificial Sequence
  Peptide Derived from Human Papillomavirus
FQVIELQMA

SEQ ID NO: 49707 - protein, 9 aa, Artificial Sequence
  Peptide Derived from Human Papillomavirus
FCADPALDN

SEQ ID NO: 49708 - protein, 9 aa, Artificial Sequence
  Peptide Derived from Human Papillomavirus
WTLQQTSLE

SEQ ID NO: 49709 - protein, 9 aa, Artificial Sequence
  Peptide Derived from Human Papillomavirus
IGMYYIHNC

SEQ ID NO: 49710 - protein, 9 aa, Artificial Sequence
  Peptide Derived from Human Papillomavirus
LLASKTKAF

SEQ ID NO: 49711 - protein, 9 aa, Artificial Sequence
  Peptide Derived from Human Papillomavirus
IRMECALLY

SEQ ID NO: 49712 - protein, 9 aa, Artificial Sequence
  Peptide Derived from Human Papillomavirus
YFKEDAAKY

SEQ ID NO: 49713 - protein, 9 aa, Artificial Sequence
  Peptide Derived from Human Papillomavirus
LYSSMSSTW

SEQ ID NO: 49714 - protein, 9 aa, Artificial Sequence
  Peptide Derived from Human Papillomavirus
WGEIYIIEE

SEQ ID NO: 49715 - protein, 9 aa, Artificial Sequence
  Peptide Derived from Human Papillomavirus
MIFVFVLCF

SEQ ID NO: 49716 - protein, 9 aa, Artificial Sequence
  Peptide Derived from Human Papillomavirus
IFVFVLCFI

SEQ ID NO: 49717 - protein, 9 aa, Artificial Sequence
  Peptide Derived from Human Papillomavirus
FVFVLCFIL

SEQ ID NO: 49718 - protein, 9 aa, Artificial Sequence
  Peptide Derived from Human Papillomavirus
LVLVLLLWV

SEQ ID NO: 49719 - protein, 9 aa, Artificial Sequence
  Peptide Derived from Human Papillomavirus
LFLCLSLLL

SEQ ID NO: 49720 - protein, 9 aa, Artificial Sequence
  Peptide Derived from Human Papillomavirus
FHAQHMTQQ

SEQ ID NO: 49721 - protein, 9 aa, Artificial Sequence
  Peptide Derived from Human Papillomavirus
LLLRPLILS

SEQ ID NO: 49722 - protein, 9 aa, Artificial Sequence
  Peptide Derived from Human Papillomavirus
LFLYLPMMC

SEQ ID NO: 49723 - protein, 9 aa, Artificial Sequence
  Peptide Derived from Human Papillomavirus
LLFLYLPMM

SEQ ID NO: 49724 - protein, 9 aa, Artificial Sequence
  Peptide Derived from Human Papillomavirus
FLCLSLLLR

SEQ ID NO: 49725 - protein, 9 aa, Artificial Sequence
  Peptide Derived from Human Papillomavirus
LPMMCINFH

SEQ ID NO: 49726 - protein, 9 aa, Artificial Sequence
  Peptide Derived from Human Papillomavirus
VLCFILFLC

SEQ ID NO: 49727 - protein, 9 aa, Artificial Sequence
  Peptide Derived from Human Papillomavirus
LKIFFCYLL

SEQ ID NO: 49728 - protein, 9 aa, Artificial Sequence
  Peptide Derived from Human Papillomavirus
FVLCFILFL

SEQ ID NO: 49729 - protein, 9 aa, Artificial Sequence
  Peptide Derived from Human Papillomavirus
LCLSLLLRP

SEQ ID NO: 49730 - protein, 9 aa, Artificial Sequence
  Peptide Derived from Human Papillomavirus
YAWLLVLVL

SEQ ID NO: 49731 - protein, 9 aa, Artificial Sequence
  Peptide Derived from Human Papillomavirus
ILFLCLSLL

SEQ ID NO: 49732 - protein, 9 aa, Artificial Sequence
  Peptide Derived from Human Papillomavirus
YLPMMCINF

SEQ ID NO: 49733 - protein, 9 aa, Artificial Sequence
  Peptide Derived from Human Papillomavirus
FFCYLLFLY

SEQ ID NO: 49734 - protein, 9 aa, Artificial Sequence
  Peptide Derived from Human Papillomavirus
LYLPMMCIN

SEQ ID NO: 49735 - protein, 9 aa, Artificial Sequence
  Peptide Derived from Human Papillomavirus
WVFVGSPLK

SEQ ID NO: 49736 - protein, 9 aa, Artificial Sequence
  Peptide Derived from Human Papillomavirus
VFVGSPLKI

SEQ ID NO: 49737 - protein, 9 aa, Artificial Sequence
  Peptide Derived from Human Papillomavirus
LILSISTYA

SEQ ID NO: 49738 - protein, 9 aa, Artificial Sequence
  Peptide Derived from Human Papillomavirus
LLRPLILSI

SEQ ID NO: 49739 - protein, 9 aa, Artificial Sequence
  Peptide Derived from Human Papillomavirus
LLWVFVGSP

SEQ ID NO: 49740 - protein, 9 aa, Artificial Sequence
  Peptide Derived from Human Papillomavirus
VLLLWVFVG

SEQ ID NO: 49741 - protein, 9 aa, Artificial Sequence
  Peptide Derived from Human Papillomavirus
FVGSPLKIF

SEQ ID NO: 49742 - protein, 9 aa, Artificial Sequence
  Peptide Derived from Human Papillomavirus
IFFCYLLFL

SEQ ID NO: 49743 - protein, 9 aa, Artificial Sequence
  Peptide Derived from Human Papillomavirus
ILSISTYAW

SEQ ID NO: 49744 - protein, 9 aa, Artificial Sequence
  Peptide Derived from Human Papillomavirus
LRPLILSIS

SEQ ID NO: 49745 - protein, 9 aa, Artificial Sequence
  Peptide Derived from Human Papillomavirus
WLLVLVLLL

SEQ ID NO: 49746 - protein, 9 aa, Artificial Sequence
  Peptide Derived from Human Papillomavirus
FILFLCLSL

SEQ ID NO: 49747 - protein, 9 aa, Artificial Sequence
  Peptide Derived from Human Papillomavirus
VLVLLLWVF

SEQ ID NO: 49748 - protein, 9 aa, Artificial Sequence
  Peptide Derived from Human Papillomavirus
LLVLVLLLW

SEQ ID NO: 49749 - protein, 9 aa, Artificial Sequence
  Peptide Derived from Human Papillomavirus
FLYLPMMCI

SEQ ID NO: 49750 - protein, 9 aa, Artificial Sequence
  Peptide Derived from Human Papillomavirus
FLSKISEYR

SEQ ID NO: 49751 - protein, 9 aa, Artificial Sequence
  Peptide Derived from Human Papillomavirus
FADLTVVYR

SEQ ID NO: 49752 - protein, 9 aa, Artificial Sequence
  Peptide Derived from Human Papillomavirus
IRCIICQRP

SEQ ID NO: 49753 - protein, 9 aa, Artificial Sequence
  Peptide Derived from Human Papillomavirus
IHNIELQCV

SEQ ID NO: 49754 - protein, 9 aa, Artificial Sequence
  Peptide Derived from Human Papillomavirus
ISGRWAGRC

SEQ ID NO: 49755 - protein, 9 aa, Artificial Sequence
  Peptide Derived from Human Papillomavirus
FGICKLCLR

SEQ ID NO: 49756 - protein, 9 aa, Artificial Sequence
  Peptide Derived from Human Papillomavirus
LCLRFLSKI

SEQ ID NO: 49757 - protein, 9 aa, Artificial Sequence
  Peptide Derived from Human Papillomavirus
IELQCVECK

SEQ ID NO: 49758 - protein, 9 aa, Artificial Sequence
  Peptide Derived from Human Papillomavirus
IICQRPLCP

SEQ ID NO: 49759 - protein, 9 aa, Artificial Sequence
  Peptide Derived from Human Papillomavirus
LNEILIRCI

SEQ ID NO: 49760 - protein, 9 aa, Artificial Sequence
  Peptide Derived from Human Papillomavirus
LQRSEVYDF

SEQ ID NO: 49761 - protein, 9 aa, Artificial Sequence
  Peptide Derived from Human Papillomavirus
ILIRCIICQ

SEQ ID NO: 49762 - protein, 9 aa, Artificial Sequence
  Peptide Derived from Human Papillomavirus
VECKKPLQR

SEQ ID NO: 49763 - protein, 9 aa, Artificial Sequence
  Peptide Derived from Human Papillomavirus
LIRCIICQR

SEQ ID NO: 49764 - protein, 9 aa, Artificial Sequence
  Peptide Derived from Human Papillomavirus
LQCVECKKP

SEQ ID NO: 49765 - protein, 9 aa, Artificial Sequence
  Peptide Derived from Human Papillomavirus
VYGNTLEQT

SEQ ID NO: 49766 - protein, 9 aa, Artificial Sequence
  Peptide Derived from Human Papillomavirus
ICKLCLRFL

SEQ ID NO: 49767 - protein, 9 aa, Artificial Sequence
  Peptide Derived from Human Papillomavirus
ICQRPLCPQ

SEQ ID NO: 49768 - protein, 9 aa, Artificial Sequence
  Peptide Derived from Human Papillomavirus
YDFAFADLT

SEQ ID NO: 49769 - protein, 9 aa, Artificial Sequence
  Peptide Derived from Human Papillomavirus
WAGRCAACW

SEQ ID NO: 49770 - protein, 9 aa, Artificial Sequence
  Peptide Derived from Human Papillomavirus
YREGNPFGI

SEQ ID NO: 49771 - protein, 9 aa, Artificial Sequence
  Peptide Derived from Human Papillomavirus
FAFADLTVV

SEQ ID NO: 49772 - protein, 9 aa, Artificial Sequence
  Peptide Derived from Human Papillomavirus
MRGHKPTLK

SEQ ID NO: 49773 - protein, 9 aa, Artificial Sequence
  Peptide Derived from Human Papillomavirus
YIVTCCHTC

SEQ ID NO: 49774 - protein, 9 aa, Artificial Sequence
  Peptide Derived from Human Papillomavirus
LLMGTVNIV

SEQ ID NO: 49775 - protein, 9 aa, Artificial Sequence
  Peptide Derived from Human Papillomavirus
VLDLYPEPT

SEQ ID NO: 49776 - protein, 9 aa, Artificial Sequence
  Peptide Derived from Human Papillomavirus
LKEYVLDLY

SEQ ID NO: 49777 - protein, 9 aa, Artificial Sequence
  Peptide Derived from Human Papillomavirus
IQQLLMGTV

SEQ ID NO: 49778 - protein, 9 aa, Artificial Sequence
  Peptide Derived from Human Papillomavirus
VNIVCPTCA

SEQ ID NO: 49779 - protein, 9 aa, Artificial Sequence
  Peptide Derived from Human Papillomavirus
MGTVNIVCP

SEQ ID NO: 49780 - protein, 9 aa, Artificial Sequence
  Peptide Derived from Human Papillomavirus
VNSTASDLR

SEQ ID NO: 49781 - protein, 9 aa, Artificial Sequence
  Peptide Derived from Human Papillomavirus
YYIVTCCHT

SEQ ID NO: 49782 - protein, 9 aa, Artificial Sequence
  Peptide Derived from Human Papillomavirus
YCYEQLSDS

SEQ ID NO: 49783 - protein, 9 aa, Artificial Sequence
  Peptide Derived from Human Papillomavirus
IVCPTCAQQ

SEQ ID NO: 49784 - protein, 9 aa, Artificial Sequence
  Peptide Derived from Human Papillomavirus
LCVNSTASD

SEQ ID NO: 49785 - protein, 9 aa, Artificial Sequence
  Peptide Derived from Human Papillomavirus
LYPEPTDLY

SEQ ID NO: 49786 - protein, 9 aa, Artificial Sequence
  Peptide Derived from Human Papillomavirus
VTCCHTCNT

SEQ ID NO: 49787 - protein, 9 aa, Artificial Sequence
  Peptide Derived from Human Papillomavirus
MSVWRPSEA

SEQ ID NO: 49788 - protein, 9 aa, Artificial Sequence
  Peptide Derived from Human Papillomavirus
MTYIHAMNP

SEQ ID NO: 49789 - protein, 9 aa, Artificial Sequence
  Peptide Derived from Human Papillomavirus
LGEAVPDDL

SEQ ID NO: 49790 - protein, 9 aa, Artificial Sequence
  Peptide Derived from Human Papillomavirus
LLVPKVSGL

SEQ ID NO: 49791 - protein, 9 aa, Artificial Sequence
  Peptide Derived from Human Papillomavirus
YLPPVPVSK

SEQ ID NO: 49792 - protein, 9 aa, Artificial Sequence
  Peptide Derived from Human Papillomavirus
MDYKQTQLC

SEQ ID NO: 49793 - protein, 9 aa, Artificial Sequence
  Peptide Derived from Human Papillomavirus
FKTLQANKS

SEQ ID NO: 49794 - protein, 9 aa, Artificial Sequence
  Peptide Derived from Human Papillomavirus
LELINTIIE

SEQ ID NO: 49795 - protein, 9 aa, Artificial Sequence
  Peptide Derived from Human Papillomavirus
VTSDSTYKN

SEQ ID NO: 49796 - protein, 9 aa, Artificial Sequence
  Peptide Derived from Human Papillomavirus
VSRTSIYYY

SEQ ID NO: 49797 - protein, 9 aa, Artificial Sequence
  Peptide Derived from Human Papillomavirus
FVFQLCKVT

SEQ ID NO: 49798 - protein, 9 aa, Artificial Sequence
  Peptide Derived from Human Papillomavirus
IKGSGTTAS

SEQ ID NO: 49799 - protein, 9 aa, Artificial Sequence
  Peptide Derived from Human Papillomavirus
FYNPDTQRL

SEQ ID NO: 49800 - protein, 9 aa, Artificial Sequence
  Peptide Derived from Human Papillomavirus
IDICGSTCK

SEQ ID NO: 49801 - protein, 9 aa, Artificial Sequence
  Peptide Derived from Human Papillomavirus
FGLTPPPSA

SEQ ID NO: 49802 - protein, 9 aa, Artificial Sequence
  Peptide Derived from Human Papillomavirus
VYLPPVPVS

SEQ ID NO: 49803 - protein, 9 aa, Artificial Sequence
  Peptide Derived from Human Papillomavirus
LKEKFSADL

SEQ ID NO: 49804 - protein, 9 aa, Artificial Sequence
  Peptide Derived from Human Papillomavirus
LRREQMFVR

SEQ ID NO: 49805 - protein, 9 aa, Artificial Sequence
  Peptide Derived from Human Papillomavirus
MDFKTLQAN

SEQ ID NO: 49806 - protein, 9 aa, Artificial Sequence
  Peptide Derived from Human Papillomavirus
LQANKSDVP

SEQ ID NO: 49807 - protein, 9 aa, Artificial Sequence
  Peptide Derived from Human Papillomavirus
WGKGVACTN

SEQ ID NO: 49808 - protein, 9 aa, Artificial Sequence
  Peptide Derived from Human Papillomavirus
VACTNAAPA

SEQ ID NO: 49809 - protein, 9 aa, Artificial Sequence
  Peptide Derived from Human Papillomavirus
IGRGQPLGV

SEQ ID NO: 49810 - protein, 9 aa, Artificial Sequence
  Peptide Derived from Human Papillomavirus
YRVFRVRLP

SEQ ID NO: 49811 - protein, 9 aa, Artificial Sequence
  Peptide Derived from Human Papillomavirus
VFVTVVDTT

SEQ ID NO: 49812 - protein, 9 aa, Artificial Sequence
  Peptide Derived from Human Papillomavirus
LGVGISGHP

SEQ ID NO: 49813 - protein, 9 aa, Artificial Sequence
  Peptide Derived from Human Papillomavirus
ISGHPLLNK

SEQ ID NO: 49814 - protein, 9 aa, Artificial Sequence
  Peptide Derived from Human Papillomavirus
FSIKNPTNA

SEQ ID NO: 49815 - protein, 9 aa, Artificial Sequence
  Peptide Derived from Human Papillomavirus
MNPDILEDW

SEQ ID NO: 49816 - protein, 9 aa, Artificial Sequence
  Peptide Derived from Human Papillomavirus
VEEYDLQFV

SEQ ID NO: 49817 - protein, 9 aa, Artificial Sequence
  Peptide Derived from Human Papillomavirus
LVPKVSGLQ

SEQ ID NO: 49818 - protein, 9 aa, Artificial Sequence
  Peptide Derived from Human Papillomavirus
LKRAAPTST

SEQ ID NO: 49819 - protein, 9 aa, Artificial Sequence
  Peptide Derived from Human Papillomavirus
VPIDICGST

SEQ ID NO: 49820 - protein, 9 aa, Artificial Sequence
  Peptide Derived from Human Papillomavirus
LTAEVMTYI

SEQ ID NO: 49821 - protein, 9 aa, Artificial Sequence
  Peptide Derived from Human Papillomavirus
FWEVDLKEK

SEQ ID NO: 49822 - protein, 9 aa, Artificial Sequence
  Peptide Derived from Human Papillomavirus
LGCKPPTGE

SEQ ID NO: 49823 - protein, 9 aa, Artificial Sequence
  Peptide Derived from Human Papillomavirus
WQFGLTPPP

SEQ ID NO: 49824 - protein, 9 aa, Artificial Sequence
  Peptide Derived from Human Papillomavirus
YTFWEVDLK

SEQ ID NO: 49825 - protein, 9 aa, Artificial Sequence
  Peptide Derived from Human Papillomavirus
FDDTETGNK

SEQ ID NO: 49826 - protein, 9 aa, Artificial Sequence
  Peptide Derived from Human Papillomavirus
VPVSKVVST

SEQ ID NO: 49827 - protein, 9 aa, Artificial Sequence
  Peptide Derived from Human Papillomavirus
WRPSEATVY

SEQ ID NO: 49828 - protein, 9 aa, Artificial Sequence
  Peptide Derived from Human Papillomavirus
IHAMNPDIL

SEQ ID NO: 49829 - protein, 9 aa, Artificial Sequence
  Peptide Derived from Human Papillomavirus
YWLQRAQGH

SEQ ID NO: 49830 - protein, 9 aa, Artificial Sequence
  Peptide Derived from Human Papillomavirus
LCTQVTSDS

SEQ ID NO: 49831 - protein, 9 aa, Artificial Sequence
  Peptide Derived from Human Papillomavirus
IEDGDMVDT

SEQ ID NO: 49832 - protein, 9 aa, Artificial Sequence
  Peptide Derived from Human Papillomavirus
LYIKGSGTT

SEQ ID NO: 49833 - protein, 9 aa, Artificial Sequence
  Peptide Derived from Human Papillomavirus
ICGSTCKYP

SEQ ID NO: 49834 - protein, 9 aa, Artificial Sequence
  Peptide Derived from Human Papillomavirus
LINTIIEDG

SEQ ID NO: 49835 - protein, 9 aa, Artificial Sequence
  Peptide Derived from Human Papillomavirus
FGFPDTSFY

SEQ ID NO: 49836 - protein, 9 aa, Artificial Sequence
  Peptide Derived from Human Papillomavirus
VSKVVSTDE

SEQ ID NO: 49837 - protein, 9 aa, Artificial Sequence
  Peptide Derived from Human Papillomavirus
YRFVTSQAI

SEQ ID NO: 49838 - protein, 9 aa, Artificial Sequence
  Peptide Derived from Human Papillomavirus
LTPPPSASL

SEQ ID NO: 49839 - protein, 9 aa, Artificial Sequence
  Peptide Derived from Human Papillomavirus
LGRKFLLQA

SEQ ID NO: 49840 - protein, 9 aa, Artificial Sequence
  Peptide Derived from Human Papillomavirus
FQLCKVTLT

SEQ ID NO: 49841 - protein, 9 aa, Artificial Sequence
  Peptide Derived from Human Papillomavirus
LLGCKPPTG

SEQ ID NO: 49842 - protein, 9 aa, Artificial Sequence
  Peptide Derived from Human Papillomavirus
LCLLGCKPP

SEQ ID NO: 49843 - protein, 9 aa, Artificial Sequence
  Peptide Derived from Human Papillomavirus
VTVVDTTRS

SEQ ID NO: 49844 - protein, 9 aa, Artificial Sequence
  Peptide Derived from Human Papillomavirus
VFRVRLPDP

SEQ ID NO: 49845 - protein, 9 aa, Artificial Sequence
  Peptide Derived from Human Papillomavirus
FNRAGTLGE

SEQ ID NO: 49846 - protein, 9 aa, Artificial Sequence
  Peptide Derived from Human Papillomavirus
LLQAGLKAK

SEQ ID NO: 49847 - protein, 9 aa, Artificial Sequence
  Peptide Derived from Human Papillomavirus
WACVGLEIG

SEQ ID NO: 49848 - protein, 9 aa, Artificial Sequence
  Peptide Derived from Human Papillomavirus
LDQFPLGRK

SEQ ID NO: 49849 - protein, 9 aa, Artificial Sequence
  Peptide Derived from Human Papillomavirus
MVTSESQLF

SEQ ID NO: 49850 - protein, 9 aa, Artificial Sequence
  Peptide Derived from Human Papillomavirus
YYAGSSRLL

SEQ ID NO: 49851 - protein, 9 aa, Artificial Sequence
  Peptide Derived from Human Papillomavirus
YKQTQLCLL

SEQ ID NO: 49852 - protein, 9 aa, Artificial Sequence
  Peptide Derived from Human Papillomavirus
ITCQKTVPP

SEQ ID NO: 49853 - protein, 9 aa, Artificial Sequence
  Peptide Derived from Human Papillomavirus
LAVGHPYFS

SEQ ID NO: 49854 - protein, 9 aa, Artificial Sequence
  Peptide Derived from Human Papillomavirus
FFPTPSGSM

SEQ ID NO: 49855 - protein, 9 aa, Artificial Sequence
  Peptide Derived from Human Papillomavirus
YVSRTSIYY

SEQ ID NO: 49856 - protein, 9 aa, Artificial Sequence
  Peptide Derived from Human Papillomavirus
LVWACVGLE

SEQ ID NO: 49857 - protein, 9 aa, Artificial Sequence
  Peptide Derived from Human Papillomavirus
YYYAGSSRL

SEQ ID NO: 49858 - protein, 9 aa, Artificial Sequence
  Peptide Derived from Human Papillomavirus
LPPVPVSKV

SEQ ID NO: 49859 - protein, 9 aa, Artificial Sequence
  Peptide Derived from Human Papillomavirus
FVTSQAITC

SEQ ID NO: 49860 - protein, 9 aa, Artificial Sequence
  Peptide Derived from Human Papillomavirus
YDLQFVFQL

SEQ ID NO: 49861 - protein, 9 aa, Artificial Sequence
  Peptide Derived from Human Papillomavirus
LCKVTLTAE

SEQ ID NO: 49862 - protein, 9 aa, Artificial Sequence
  Peptide Derived from Human Papillomavirus
VRLPDPNKF

SEQ ID NO: 49863 - protein, 9 aa, Artificial Sequence
  Peptide Derived from Human Papillomavirus
VDTTRSTNM

SEQ ID NO: 49864 - protein, 9 aa, Artificial Sequence
  Peptide Derived from Human Papillomavirus
YLKMTSEPY

SEQ ID NO: 49865 - protein, 9 aa, Artificial Sequence
  Peptide Derived from Human Papillomavirus
VTSQAITCQ

SEQ ID NO: 49866 - protein, 9 aa, Artificial Sequence
  Peptide Derived from Human Papillomavirus
FRVRLPDPN

SEQ ID NO: 49867 - protein, 9 aa, Artificial Sequence
  Peptide Derived from Human Papillomavirus
MRHKRSTRR

SEQ ID NO: 49868 - protein, 9 aa, Artificial Sequence
  Peptide Derived from Human Papillomavirus
VDNVHTPMQ

SEQ ID NO: 49869 - protein, 9 aa, Artificial Sequence
  Peptide Derived from Human Papillomavirus
ILKYGSLGV

SEQ ID NO: 49870 - protein, 9 aa, Artificial Sequence
  Peptide Derived from Human Papillomavirus
LQPIRPPVT

SEQ ID NO: 49871 - protein, 9 aa, Artificial Sequence
  Peptide Derived from Human Papillomavirus
FLDIIALHR

SEQ ID NO: 49872 - protein, 9 aa, Artificial Sequence
  Peptide Derived from Human Papillomavirus
LKYGSLGVF

SEQ ID NO: 49873 - protein, 9 aa, Artificial Sequence
  Peptide Derived from Human Papillomavirus
VVSTDSSNV

SEQ ID NO: 49874 - protein, 9 aa, Artificial Sequence
  Peptide Derived from Human Papillomavirus
LQFQHSDIS

SEQ ID NO: 49875 - protein, 9 aa, Artificial Sequence
  Peptide Derived from Human Papillomavirus
VLHPPAPAE

SEQ ID NO: 49876 - protein, 9 aa, Artificial Sequence
  Peptide Derived from Human Papillomavirus
IQTISTHLN

SEQ ID NO: 49877 - protein, 9 aa, Artificial Sequence
  Peptide Derived from Human Papillomavirus
FIEAGAPAP

SEQ ID NO: 49878 - protein, 9 aa, Artificial Sequence
  Peptide Derived from Human Papillomavirus
IVVDGADFV

SEQ ID NO: 49879 - protein, 9 aa, Artificial Sequence
  Peptide Derived from Human Papillomavirus
FDPEDTLQF

SEQ ID NO: 49880 - protein, 9 aa, Artificial Sequence
  Peptide Derived from Human Papillomavirus
FDTIVVDGA

SEQ ID NO: 49881 - protein, 9 aa, Artificial Sequence
  Peptide Derived from Human Papillomavirus
VGQKATLKT

SEQ ID NO: 49882 - protein, 9 aa, Artificial Sequence
  Peptide Derived from Human Papillomavirus
ISPFFPFDT

SEQ ID NO: 49883 - protein, 9 aa, Artificial Sequence
  Peptide Derived from Human Papillomavirus
FVLHPSYFI

SEQ ID NO: 49884 - protein, 9 aa, Artificial Sequence
  Peptide Derived from Human Papillomavirus
IFSSPTVST

SEQ ID NO: 49885 - protein, 9 aa, Artificial Sequence
  Peptide Derived from Human Papillomavirus
IADQILKYG

SEQ ID NO: 49886 - protein, 9 aa, Artificial Sequence
  Peptide Derived from Human Papillomavirus
FGGLGIGTG

SEQ ID NO: 49887 - protein, 9 aa, Artificial Sequence
  Peptide Derived from Human Papillomavirus
FSSPTVSTQ

SEQ ID NO: 49888 - protein, 9 aa, Artificial Sequence
  Peptide Derived from Human Papillomavirus
ITYDNPAFE

SEQ ID NO: 49889 - protein, 9 aa, Artificial Sequence
  Peptide Derived from Human Papillomavirus
MQHSYSTFA

SEQ ID NO: 49890 - protein, 9 aa, Artificial Sequence
  Peptide Derived from Human Papillomavirus
YQDLSPIVP

SEQ ID NO: 49891 - protein, 9 aa, Artificial Sequence
  Peptide Derived from Human Papillomavirus
LHRPAITSR

SEQ ID NO: 49892 - protein, 9 aa, Artificial Sequence
  Peptide Derived from Human Papillomavirus
YGSLGVFFG

SEQ ID NO: 49893 - protein, 9 aa, Artificial Sequence
  Peptide Derived from Human Papillomavirus
VEGSTIADQ

SEQ ID NO: 49894 - protein, 9 aa, Artificial Sequence
  Peptide Derived from Human Papillomavirus
FFPFDTIVV

SEQ ID NO: 49895 - protein, 9 aa, Artificial Sequence
  Peptide Derived from Human Papillomavirus
LDHTVPNEQ

SEQ ID NO: 49896 - protein, 9 aa, Artificial Sequence
  Peptide Derived from Human Papillomavirus
LIEETSFIE

SEQ ID NO: 49897 - protein, 9 aa, Artificial Sequence
  Peptide Derived from Human Papillomavirus
IALHRPAIT

SEQ ID NO: 49898 - protein, 9 aa, Artificial Sequence
  Peptide Derived from Human Papillomavirus
IRPPVTVDT

SEQ ID NO: 49899 - protein, 9 aa, Artificial Sequence
  Peptide Derived from Human Papillomavirus
LHDTSTSSY

SEQ ID NO: 49900 - protein, 9 aa, Artificial Sequence
  Peptide Derived from Human Papillomavirus
VYADDVDNV

SEQ ID NO: 49901 - protein, 9 aa, Artificial Sequence
  Peptide Derived from Human Papillomavirus
LYDVYADDV

SEQ ID NO: 49902 - protein, 9 aa, Artificial Sequence
  Peptide Derived from Human Papillomavirus
YELQPLHDT

SEQ ID NO: 49903 - protein, 9 aa, Artificial Sequence
  Peptide Derived from Human Papillomavirus
MDTFVVSTD

SEQ ID NO: 49904 - protein, 9 aa, Artificial Sequence
  Peptide Derived from Human Papillomavirus
FESFDPEDT

SEQ ID NO: 49905 - protein, 9 aa, Artificial Sequence
  Peptide Derived from Human Papillomavirus
FTEPSVLHP

SEQ ID NO: 49906 - protein, 9 aa, Artificial Sequence
  Peptide Derived from Human Papillomavirus
FDTPVMSGP

SEQ ID NO: 49907 - protein, 9 aa, Artificial Sequence
  Peptide Derived from Human Papillomavirus
INVSSVGES

SEQ ID NO: 49908 - protein, 9 aa, Artificial Sequence
  Peptide Derived from Human Papillomavirus
LDIIALHRP

SEQ ID NO: 49909 - protein, 9 aa, Artificial Sequence
  Peptide Derived from Human Papillomavirus
FDVTTSADT

SEQ ID NO: 49910 - protein, 9 aa, Artificial Sequence
  Peptide Derived from Human Papillomavirus
LFPTSSPFV

SEQ ID NO: 49911 - protein, 9 aa, Artificial Sequence
  Peptide Derived from Human Papillomavirus
LHPPAPAEA

SEQ ID NO: 49912 - protein, 9 aa, Artificial Sequence
  Peptide Derived from Human Papillomavirus
VDTVGPLDS

SEQ ID NO: 49913 - protein, 9 aa, Artificial Sequence
  Peptide Derived from Human Papillomavirus
YSTFATTRT

SEQ ID NO: 49914 - protein, 9 aa, Artificial Sequence
  Peptide Derived from Human Papillomavirus
YFFTDVRVA

SEQ ID NO: 49915 - protein, 9 aa, Artificial Sequence
  Peptide Derived from Human Papillomavirus
VRFSRVGQK

SEQ ID NO: 49916 - protein, 9 aa, Artificial Sequence
  Peptide Derived from Human Papillomavirus
YYQDLSPIV

SEQ ID NO: 49917 - protein, 9 aa, Artificial Sequence
  Peptide Derived from Human Papillomavirus
FPYFFTDVR

SEQ ID NO: 49918 - protein, 9 aa, Artificial Sequence
  Peptide Derived from Human Papillomavirus
LYSRNTQQV

SEQ ID NO: 49919 - protein, 9 aa, Artificial Sequence
  Peptide Derived from Human Papillomavirus
VTVDTVGPL

SEQ ID NO: 49920 - protein, 9 aa, Artificial Sequence
  Peptide Derived from Human Papillomavirus
YVPIGTDPP

SEQ ID NO: 49921 - protein, 9 aa, Artificial Sequence
  Peptide Derived from Human Papillomavirus
FIFSSPTVS

SEQ ID NO: 49922 - protein, 9 aa, Artificial Sequence
  Peptide Derived from Human Papillomavirus
VFFGGLGIG

SEQ ID NO: 49923 - protein, 9 aa, Artificial Sequence
  Peptide Derived from Human Papillomavirus
FPFDTIVVD

SEQ ID NO: 49924 - protein, 9 aa, Artificial Sequence
  Peptide Derived from Human Papillomavirus
VPLDHTVPN

SEQ ID NO: 49925 - protein, 9 aa, Artificial Sequence
  Peptide Derived from Human Papillomavirus
FPTSSPFVP

SEQ ID NO: 49926 - protein, 9 aa, Artificial Sequence
  Peptide Derived from Human Papillomavirus
VARLGLYSR

SEQ ID NO: 49927 - protein, 9 aa, Artificial Sequence
  Peptide Derived from Human Papillomavirus
VTSSTPIPG

SEQ ID NO: 49928 - protein, 9 aa, Artificial Sequence
  Peptide Derived from Human Papillomavirus
FVPISPFFP

SEQ ID NO: 49929 - protein, 9 aa, Artificial Sequence
  Peptide Derived from Human Papillomavirus
LNPTFTEPS

SEQ ID NO: 49930 - protein, 9 aa, Artificial Sequence
  Peptide Derived from Human Papillomavirus
IPGSRPVAR

SEQ ID NO: 49931 - protein, 9 aa, Artificial Sequence
  Peptide Derived from Human Papillomavirus
IPLQPIRPP

SEQ ID NO: 49932 - protein, 9 aa, Artificial Sequence
  Peptide Derived from Human Papillomavirus
VSTDSSNVT

SEQ ID NO: 49933 - protein, 9 aa, Artificial Sequence
  Peptide Derived from Human Papillomavirus
FQHSDISPA

SEQ ID NO: 49934 - protein, 9 aa, Artificial Sequence
  Peptide Derived from Human Papillomavirus
IINVSSVGE

SEQ ID NO: 49935 - protein, 9 aa, Artificial Sequence
  Peptide Derived from Human Papillomavirus
MSGPDIPSP

SEQ ID NO: 49936 - protein, 9 aa, Artificial Sequence
  Peptide Derived from Human Papillomavirus
YQTCKATGT

SEQ ID NO: 49937 - protein, 9 aa, Artificial Sequence
  Peptide Derived from Human Papillomavirus
VKVVDPAFL

SEQ ID NO: 49938 - protein, 9 aa, Artificial Sequence
  Peptide Derived from Human Papillomavirus
YENIPMDTF

SEQ ID NO: 49939 - protein, 9 aa, Artificial Sequence
  Peptide Derived from Human Papillomavirus
IEAGAPAPS

SEQ ID NO: 49940 - protein, 9 aa, Artificial Sequence
  Peptide Derived from Human Papillomavirus
VGPLDSSIV

SEQ ID NO: 49941 - protein, 9 aa, Artificial Sequence
  Peptide Derived from Human Papillomavirus
LDSSIVSLI

SEQ ID NO: 49942 - protein, 9 aa, Artificial Sequence
  Peptide Derived from Human Papillomavirus
VDPAFLTSP

SEQ ID NO: 49943 - protein, 9 aa, Artificial Sequence
  Peptide Derived from Human Papillomavirus
VGESSIQTI

SEQ ID NO: 49944 - protein, 9 aa, Artificial Sequence
  Peptide Derived from Human Papillomavirus
LSPIVPLDH

SEQ ID NO: 49945 - protein, 9 aa, Artificial Sequence
  Peptide Derived from Human Papillomavirus
FATTRTSNV

SEQ ID NO: 49946 - protein, 9 aa, Artificial Sequence
  Peptide Derived from Human Papillomavirus
IGTDPPTAA

SEQ ID NO: 49947 - protein, 9 aa, Artificial Sequence
  Peptide Derived from Human Papillomavirus
FLKSNCQAK

SEQ ID NO: 49948 - protein, 9 aa, Artificial Sequence
  Peptide Derived from Human Papillomavirus
VDPHCSITE

SEQ ID NO: 49949 - protein, 9 aa, Artificial Sequence
  Peptide Derived from Human Papillomavirus
LKDCAVMCR

SEQ ID NO: 49950 - protein, 9 aa, Artificial Sequence
  Peptide Derived from Human Papillomavirus
WYRTGISNI

SEQ ID NO: 49951 - protein, 9 aa, Artificial Sequence
  Peptide Derived from Human Papillomavirus
YAHIQCLDC

SEQ ID NO: 49952 - protein, 9 aa, Artificial Sequence
  Peptide Derived from Human Papillomavirus
IEPPKLRSS

SEQ ID NO: 49953 - protein, 9 aa, Artificial Sequence
  Peptide Derived from Human Papillomavirus
WFFVETIVE

SEQ ID NO: 49954 - protein, 9 aa, Artificial Sequence
  Peptide Derived from Human Papillomavirus
VEAAETQVT

SEQ ID NO: 49955 - protein, 9 aa, Artificial Sequence
  Peptide Derived from Human Papillomavirus
YFDNYMRNA

SEQ ID NO: 49956 - protein, 9 aa, Artificial Sequence
  Peptide Derived from Human Papillomavirus
WGVLILALL

SEQ ID NO: 49957 - protein, 9 aa, Artificial Sequence
  Peptide Derived from Human Papillomavirus
FQYAQLADC

SEQ ID NO: 49958 - protein, 9 aa, Artificial Sequence
  Peptide Derived from Human Papillomavirus
WPYLESRVT

SEQ ID NO: 49959 - protein, 9 aa, Artificial Sequence
  Peptide Derived from Human Papillomavirus
YGCSEVEAA

SEQ ID NO: 49960 - protein, 9 aa, Artificial Sequence
  Peptide Derived from Human Papillomavirus
FDLSDMVQW

SEQ ID NO: 49961 - protein, 9 aa, Artificial Sequence
  Peptide Derived from Human Papillomavirus
MAIFGVNPT

SEQ ID NO: 49962 - protein, 9 aa, Artificial Sequence
  Peptide Derived from Human Papillomavirus
WSRLDLHED

SEQ ID NO: 49963 - protein, 9 aa, Artificial Sequence
  Peptide Derived from Human Papillomavirus
MAFQYAQLA

SEQ ID NO: 49964 - protein, 9 aa, Artificial Sequence
  Peptide Derived from Human Papillomavirus
MLIEPPKLR

SEQ ID NO: 49965 - protein, 9 aa, Artificial Sequence
  Peptide Derived from Human Papillomavirus
YMRNALDGN

SEQ ID NO: 49966 - protein, 9 aa, Artificial Sequence
  Peptide Derived from Human Papillomavirus
FLQGAIISF

SEQ ID NO: 49967 - protein, 9 aa, Artificial Sequence
  Peptide Derived from Human Papillomavirus
VTGQNTRPL

SEQ ID NO: 49968 - protein, 9 aa, Artificial Sequence
  Peptide Derived from Human Papillomavirus
LIKPATLYA

SEQ ID NO: 49969 - protein, 9 aa, Artificial Sequence
  Peptide Derived from Human Papillomavirus
ISFVNSNSH

SEQ ID NO: 49970 - protein, 9 aa, Artificial Sequence
  Peptide Derived from Human Papillomavirus
VHSTQSSGG

SEQ ID NO: 49971 - protein, 9 aa, Artificial Sequence
  Peptide Derived from Human Papillomavirus
FGTFKCVTG

SEQ ID NO: 49972 - protein, 9 aa, Artificial Sequence
  Peptide Derived from Human Papillomavirus
FVETIVEKK

SEQ ID NO: 49973 - protein, 9 aa, Artificial Sequence
  Peptide Derived from Human Papillomavirus
LLQLKCPPI

SEQ ID NO: 49974 - protein, 9 aa, Artificial Sequence
  Peptide Derived from Human Papillomavirus
VNPTVAEGF

SEQ ID NO: 49975 - protein, 9 aa, Artificial Sequence
  Peptide Derived from Human Papillomavirus
LQGAIISFV

SEQ ID NO: 49976 - protein, 9 aa, Artificial Sequence
  Peptide Derived from Human Papillomavirus
FVNSNSHFW

SEQ ID NO: 49977 - protein, 9 aa, Artificial Sequence
  Peptide Derived from Human Papillomavirus
LLRYKCGKN

SEQ ID NO: 49978 - protein, 9 aa, Artificial Sequence
  Peptide Derived from Human Papillomavirus
YGPANTGKS

SEQ ID NO: 49979 - protein, 9 aa, Artificial Sequence
  Peptide Derived from Human Papillomavirus
VSGDTPEWI

SEQ ID NO: 49980 - protein, 9 aa, Artificial Sequence
  Peptide Derived from Human Papillomavirus
LSFTDLVRN

SEQ ID NO: 49981 - protein, 9 aa, Artificial Sequence
  Peptide Derived from Human Papillomavirus
FERTWSRLD

SEQ ID NO: 49982 - protein, 9 aa, Artificial Sequence
  Peptide Derived from Human Papillomavirus
YGLSFTDLV

SEQ ID NO: 49983 - protein, 9 aa, Artificial Sequence
  Peptide Derived from Human Papillomavirus
ILLYGPANT

SEQ ID NO: 49984 - protein, 9 aa, Artificial Sequence
  Peptide Derived from Human Papillomavirus
LQLKCPPIL

SEQ ID NO: 49985 - protein, 9 aa, Artificial Sequence
  Peptide Derived from Human Papillomavirus
FGMSFIHFL

SEQ ID NO: 49986 - protein, 9 aa, Artificial Sequence
  Peptide Derived from Human Papillomavirus
IKPATLYAH

SEQ ID NO: 49987 - protein, 9 aa, Artificial Sequence
  Peptide Derived from Human Papillomavirus
MLDDATHTC

SEQ ID NO: 49988 - protein, 9 aa, Artificial Sequence
  Peptide Derived from Human Papillomavirus
VLILALLRY

SEQ ID NO: 49989 - protein, 9 aa, Artificial Sequence
  Peptide Derived from Human Papillomavirus
YLESRVTVF

SEQ ID NO: 49990 - protein, 9 aa, Artificial Sequence
  Peptide Derived from Human Papillomavirus
LADTKVAML

SEQ ID NO: 49991 - protein, 9 aa, Artificial Sequence
  Peptide Derived from Human Papillomavirus
LKRKFAGGS

SEQ ID NO: 49992 - protein, 9 aa, Artificial Sequence
  Peptide Derived from Human Papillomavirus
FLKGTPKKN

SEQ ID NO: 49993 - protein, 9 aa, Artificial Sequence
  Peptide Derived from Human Papillomavirus
VPETCMLIE

SEQ ID NO: 49994 - protein, 9 aa, Artificial Sequence
  Peptide Derived from Human Papillomavirus
LKCPPILLT

SEQ ID NO: 49995 - protein, 9 aa, Artificial Sequence
  Peptide Derived from Human Papillomavirus
YRTGISNIS

SEQ ID NO: 49996 - protein, 9 aa, Artificial Sequence
  Peptide Derived from Human Papillomavirus
FGVNPTVAE

SEQ ID NO: 49997 - protein, 9 aa, Artificial Sequence
  Peptide Derived from Human Papillomavirus
WIKYRCSKI

SEQ ID NO: 49998 - protein, 9 aa, Artificial Sequence
  Peptide Derived from Human Papillomavirus
FIDTQLSIC

SEQ ID NO: 49999 - protein, 9 aa, Artificial Sequence
  Peptide Derived from Human Papillomavirus
LLYGPANTG

SEQ ID NO: 50000 - protein, 9 aa, Artificial Sequence
  Peptide Derived from Human Papillomavirus
FFVETIVEK

SEQ ID NO: 50001 - protein, 9 aa, Artificial Sequence
  Peptide Derived from Human Papillomavirus
FWLEPLADT

SEQ ID NO: 50002 - protein, 9 aa, Artificial Sequence
  Peptide Derived from Human Papillomavirus
LGEQLSVDT

SEQ ID NO: 50003 - protein, 9 aa, Artificial Sequence
  Peptide Derived from Human Papillomavirus
IQRLTIIQH

SEQ ID NO: 50004 - protein, 9 aa, Artificial Sequence
  Peptide Derived from Human Papillomavirus
LLTSNIDPA

SEQ ID NO: 50005 - protein, 9 aa, Artificial Sequence
  Peptide Derived from Human Papillomavirus
LRSSVAALY

SEQ ID NO: 50006 - protein, 9 aa, Artificial Sequence
  Peptide Derived from Human Papillomavirus
YLKDCAVMC

SEQ ID NO: 50007 - protein, 9 aa, Artificial Sequence
  Peptide Derived from Human Papillomavirus
FHAQEVQND

SEQ ID NO: 50008 - protein, 9 aa, Artificial Sequence
  Peptide Derived from Human Papillomavirus
VDTDLSPRL

SEQ ID NO: 50009 - protein, 9 aa, Artificial Sequence
  Peptide Derived from Human Papillomavirus
FDNDLTDES

SEQ ID NO: 50010 - protein, 9 aa, Artificial Sequence
  Peptide Derived from Human Papillomavirus
IIQHGIDDS

SEQ ID NO: 50011 - protein, 9 aa, Artificial Sequence
  Peptide Derived from Human Papillomavirus
VAKGLSTLL

SEQ ID NO: 50012 - protein, 9 aa, Artificial Sequence
  Peptide Derived from Human Papillomavirus
LDGNPISID

SEQ ID NO: 50013 - protein, 9 aa, Artificial Sequence
  Peptide Derived from Human Papillomavirus
FTISDSGYG

SEQ ID NO: 50014 - protein, 9 aa, Artificial Sequence
  Peptide Derived from Human Papillomavirus
VDFIDTQLS

SEQ ID NO: 50015 - protein, 9 aa, Artificial Sequence
  Peptide Derived from Human Papillomavirus
WLEPLADTK

SEQ ID NO: 50016 - protein, 9 aa, Artificial Sequence
  Peptide Derived from Human Papillomavirus
LQEISLNSG

SEQ ID NO: 50017 - protein, 9 aa, Artificial Sequence
  Peptide Derived from Human Papillomavirus
IKYRCSKID

SEQ ID NO: 50018 - protein, 9 aa, Artificial Sequence
  Peptide Derived from Human Papillomavirus
LHVPETCML

SEQ ID NO: 50019 - protein, 9 aa, Artificial Sequence
  Peptide Derived from Human Papillomavirus
VRNFKSDKT

SEQ ID NO: 50020 - protein, 9 aa, Artificial Sequence
  Peptide Derived from Human Papillomavirus
WIQRLTIIQ

SEQ ID NO: 50021 - protein, 9 aa, Artificial Sequence
  Peptide Derived from Human Papillomavirus
LYWYRTGIS

SEQ ID NO: 50022 - protein, 9 aa, Artificial Sequence
  Peptide Derived from Human Papillomavirus
IDTQLSICE

SEQ ID NO: 50023 - protein, 9 aa, Artificial Sequence
  Peptide Derived from Human Papillomavirus
ISFLRALKE

SEQ ID NO: 50024 - protein, 9 aa, Artificial Sequence
  Peptide Derived from Human Papillomavirus
IVEKKTGDV

SEQ ID NO: 50025 - protein, 9 aa, Artificial Sequence
  Peptide Derived from Human Papillomavirus
FPHAFPFDK

SEQ ID NO: 50026 - protein, 9 aa, Artificial Sequence
  Peptide Derived from Human Papillomavirus
IFGVNPTVA

SEQ ID NO: 50027 - protein, 9 aa, Artificial Sequence
  Peptide Derived from Human Papillomavirus
LRYQGVEFI

SEQ ID NO: 50028 - protein, 9 aa, Artificial Sequence
  Peptide Derived from Human Papillomavirus
FKSDKTTCT

SEQ ID NO: 50029 - protein, 9 aa, Artificial Sequence
  Peptide Derived from Human Papillomavirus
FTFPHAFPF

SEQ ID NO: 50030 - protein, 9 aa, Artificial Sequence
  Peptide Derived from Human Papillomavirus
LILALLRYK

SEQ ID NO: 50031 - protein, 9 aa, Artificial Sequence
  Peptide Derived from Human Papillomavirus
YRCSKIDEG

SEQ ID NO: 50032 - protein, 9 aa, Artificial Sequence
  Peptide Derived from Human Papillomavirus
LESRVTVFT

SEQ ID NO: 50033 - protein, 9 aa, Artificial Sequence
  Peptide Derived from Human Papillomavirus
IQCLDCKWG

SEQ ID NO: 50034 - protein, 9 aa, Artificial Sequence
  Peptide Derived from Human Papillomavirus
LADCNSNAA

SEQ ID NO: 50035 - protein, 9 aa, Artificial Sequence
  Peptide Derived from Human Papillomavirus
MKMQTPKES

SEQ ID NO: 50036 - protein, 9 aa, Artificial Sequence
  Peptide Derived from Human Papillomavirus
VSYWGVYYI

SEQ ID NO: 50037 - protein, 9 aa, Artificial Sequence
  Peptide Derived from Human Papillomavirus
YSEISSTWH

SEQ ID NO: 50038 - protein, 9 aa, Artificial Sequence
  Peptide Derived from Human Papillomavirus
LWNTEPSQC

SEQ ID NO: 50039 - protein, 9 aa, Artificial Sequence
  Peptide Derived from Human Papillomavirus
YGNSNTWEV

SEQ ID NO: 50040 - protein, 9 aa, Artificial Sequence
  Peptide Derived from Human Papillomavirus
YVVWDSIYY

SEQ ID NO: 50041 - protein, 9 aa, Artificial Sequence
  Peptide Derived from Human Papillomavirus
VSATQIVRQ

SEQ ID NO: 50042 - protein, 9 aa, Artificial Sequence
  Peptide Derived from Human Papillomavirus
YYITETGIW

SEQ ID NO: 50043 - protein, 9 aa, Artificial Sequence
  Peptide Derived from Human Papillomavirus
WNTEPSQCF

SEQ ID NO: 50044 - protein, 9 aa, Artificial Sequence
  Peptide Derived from Human Papillomavirus
MALKGLAQS

SEQ ID NO: 50045 - protein, 9 aa, Artificial Sequence
  Peptide Derived from Human Papillomavirus
IWDKTAACV

SEQ ID NO: 50046 - protein, 9 aa, Artificial Sequence
  Peptide Derived from Human Papillomavirus
YGGNVIDCN

SEQ ID NO: 50047 - protein, 9 aa, Artificial Sequence
  Peptide Derived from Human Papillomavirus
IDCNDSMCS

SEQ ID NO: 50048 - protein, 9 aa, Artificial Sequence
  Peptide Derived from Human Papillomavirus
IELQMALKG

SEQ ID NO: 50049 - protein, 9 aa, Artificial Sequence
  Peptide Derived from Human Papillomavirus
LLCSSTSNN

SEQ ID NO: 50050 - protein, 9 aa, Artificial Sequence
  Peptide Derived from Human Papillomavirus
VPPINISKS

SEQ ID NO: 50051 - protein, 9 aa, Artificial Sequence
  Peptide Derived from Human Papillomavirus
WQLIRLENA

SEQ ID NO: 50052 - protein, 9 aa, Artificial Sequence
  Peptide Derived from Human Papillomavirus
LNHQVVPPI

SEQ ID NO: 50053 - protein, 9 aa, Artificial Sequence
  Peptide Derived from Human Papillomavirus
ITETGIWDK

SEQ ID NO: 50054 - protein, 9 aa, Artificial Sequence
  Peptide Derived from Human Papillomavirus
LSERLSALQ

SEQ ID NO: 50055 - protein, 9 aa, Artificial Sequence
  Peptide Derived from Human Papillomavirus
IQTPATKRP

SEQ ID NO: 50056 - protein, 9 aa, Artificial Sequence
  Peptide Derived from Human Papillomavirus
VTIPNSVQI

SEQ ID NO: 50057 - protein, 9 aa, Artificial Sequence
  Peptide Derived from Human Papillomavirus
LENAILFTA

SEQ ID NO: 50058 - protein, 9 aa, Artificial Sequence
  Peptide Derived from Human Papillomavirus
YADHYSEIS

SEQ ID NO: 50059 - protein, 9 aa, Artificial Sequence
  Peptide Derived from Human Papillomavirus
LQDKILDHY

SEQ ID NO: 50060 - protein, 9 aa, Artificial Sequence
  Peptide Derived from Human Papillomavirus
VVWDSIYYI

SEQ ID NO: 50061 - protein, 9 aa, Artificial Sequence
  Peptide Derived from Human Papillomavirus
WTLQDTCEE

SEQ ID NO: 50062 - protein, 9 aa, Artificial Sequence
  Peptide Derived from Human Papillomavirus
LCSSTSNNK

SEQ ID NO: 50063 - protein, 9 aa, Artificial Sequence
  Peptide Derived from Human Papillomavirus
ISYWQLIRL

SEQ ID NO: 50064 - protein, 9 aa, Artificial Sequence
  Peptide Derived from Human Papillomavirus
LDVVTIPNS

SEQ ID NO: 50065 - protein, 9 aa, Artificial Sequence
  Peptide Derived from Human Papillomavirus
VHNPLLCSS

SEQ ID NO: 50066 - protein, 9 aa, Artificial Sequence
  Peptide Derived from Human Papillomavirus
ISKSKAHKA

SEQ ID NO: 50067 - protein, 9 aa, Artificial Sequence
  Peptide Derived from Human Papillomavirus
FLDVVTIPN

SEQ ID NO: 50068 - protein, 9 aa, Artificial Sequence
  Peptide Derived from Human Papillomavirus
VCSGNTTPI

SEQ ID NO: 50069 - protein, 9 aa, Artificial Sequence
  Peptide Derived from Human Papillomavirus
INSQISYWQ

SEQ ID NO: 50070 - protein, 9 aa, Artificial Sequence
  Peptide Derived from Human Papillomavirus
WHWTGCNKN

SEQ ID NO: 50071 - protein, 9 aa, Artificial Sequence
  Peptide Derived from Human Papillomavirus
VGTPKPHIQ

SEQ ID NO: 50072 - protein, 9 aa, Artificial Sequence
  Peptide Derived from Human Papillomavirus
WDKTAACVS

SEQ ID NO: 50073 - protein, 9 aa, Artificial Sequence
  Peptide Derived from Human Papillomavirus
YVQFKSECE

SEQ ID NO: 50074 - protein, 9 aa, Artificial Sequence
  Peptide Derived from Human Papillomavirus
INISKSKAH

SEQ ID NO: 50075 - protein, 9 aa, Artificial Sequence
  Peptide Derived from Human Papillomavirus
LQHASTSTP

SEQ ID NO: 50076 - protein, 9 aa, Artificial Sequence
  Peptide Derived from Human Papillomavirus
WGVYYIKDG

SEQ ID NO: 50077 - protein, 9 aa, Artificial Sequence
  Peptide Derived from Human Papillomavirus
IKDGDTTYY

SEQ ID NO: 50078 - protein, 9 aa, Artificial Sequence
  Peptide Derived from Human Papillomavirus
IRLENAILF

SEQ ID NO: 50079 - protein, 9 aa, Artificial Sequence
  Peptide Derived from Human Papillomavirus
YCKATLERT

SEQ ID NO: 50080 - protein, 9 aa, Artificial Sequence
  Peptide Derived from Human Papillomavirus
IVYRDCIAY

SEQ ID NO: 50081 - protein, 9 aa, Artificial Sequence
  Peptide Derived from Human Papillomavirus
IACVYCKAT

SEQ ID NO: 50082 - protein, 9 aa, Artificial Sequence
  Peptide Derived from Human Papillomavirus
YYSNSVYGE

SEQ ID NO: 50083 - protein, 9 aa, Artificial Sequence
  Peptide Derived from Human Papillomavirus
YRDCIAYAA

SEQ ID NO: 50084 - protein, 9 aa, Artificial Sequence
  Peptide Derived from Human Papillomavirus
VYCKATLER

SEQ ID NO: 50085 - protein, 9 aa, Artificial Sequence
  Peptide Derived from Human Papillomavirus
LRCQKPLNP

SEQ ID NO: 50086 - protein, 9 aa, Artificial Sequence
  Peptide Derived from Human Papillomavirus
LERTEVYQF

SEQ ID NO: 50087 - protein, 9 aa, Artificial Sequence
  Peptide Derived from Human Papillomavirus
ITNTELYNL

SEQ ID NO: 50088 - protein, 9 aa, Artificial Sequence
  Peptide Derived from Human Papillomavirus
VYRDCIAYA

SEQ ID NO: 50089 - protein, 9 aa, Artificial Sequence
  Peptide Derived from Human Papillomavirus
VSIACVYCK

SEQ ID NO: 50090 - protein, 9 aa, Artificial Sequence
  Peptide Derived from Human Papillomavirus
LLIRCLRCQ

SEQ ID NO: 50091 - protein, 9 aa, Artificial Sequence
  Peptide Derived from Human Papillomavirus
IRCLRCQKP

SEQ ID NO: 50092 - protein, 9 aa, Artificial Sequence
  Peptide Derived from Human Papillomavirus
LYNLLIRCL

SEQ ID NO: 50093 - protein, 9 aa, Artificial Sequence
  Peptide Derived from Human Papillomavirus
LQDVSIACV

SEQ ID NO: 50094 - protein, 9 aa, Artificial Sequence
  Peptide Derived from Human Papillomavirus
LPDLCTELN

SEQ ID NO: 50095 - protein, 9 aa, Artificial Sequence
  Peptide Derived from Human Papillomavirus
FKDLFIVYR

SEQ ID NO: 50096 - protein, 9 aa, Artificial Sequence
  Peptide Derived from Human Papillomavirus
YKLPDLCTE

SEQ ID NO: 50097 - protein, 9 aa, Artificial Sequence
  Peptide Derived from Human Papillomavirus
IAYAACHKC

SEQ ID NO: 50098 - protein, 9 aa, Artificial Sequence
  Peptide Derived from Human Papillomavirus
VYGETLEKI

SEQ ID NO: 50099 - protein, 9 aa, Artificial Sequence
  Peptide Derived from Human Papillomavirus
FAFKDLFIV

SEQ ID NO: 50100 - protein, 9 aa, Artificial Sequence
  Peptide Derived from Human Papillomavirus
MHGPRATLQ

SEQ ID NO: 50101 - protein, 9 aa, Artificial Sequence
  Peptide Derived from Human Papillomavirus
VSHAQLPAR

SEQ ID NO: 50102 - protein, 9 aa, Artificial Sequence
  Peptide Derived from Human Papillomavirus
LPARRAEPQ

SEQ ID NO: 50103 - protein, 9 aa, Artificial Sequence
  Peptide Derived from Human Papillomavirus
LFLSTLSFV

SEQ ID NO: 50104 - protein, 9 aa, Artificial Sequence
  Peptide Derived from Human Papillomavirus
LQQLFLSTL

SEQ ID NO: 50105 - protein, 9 aa, Artificial Sequence
  Peptide Derived from Human Papillomavirus
VCPWCATNQ

SEQ ID NO: 50106 - protein, 9 aa, Artificial Sequence
  Peptide Derived from Human Papillomavirus
LSFVCPWCA

SEQ ID NO: 50107 - protein, 9 aa, Artificial Sequence
  Peptide Derived from Human Papillomavirus
VLHLEPQNE

SEQ ID NO: 50108 - protein, 9 aa, Artificial Sequence
  Peptide Derived from Human Papillomavirus
LDPVDLLCY

SEQ ID NO: 50109 - protein, 9 aa, Artificial Sequence
  Peptide Derived from Human Papillomavirus
FLSTLSFVC

SEQ ID NO: 50110 - protein, 9 aa, Artificial Sequence
  Peptide Derived from Human Papillomavirus
LQEIVLHLE

SEQ ID NO: 50111 - protein, 9 aa, Artificial Sequence
  Peptide Derived from Human Papillomavirus
ILCVCCKCD

SEQ ID NO: 50112 - protein, 9 aa, Artificial Sequence
  Peptide Derived from Human Papillomavirus
LTVESSADD

SEQ ID NO: 50113 - protein, 9 aa, Artificial Sequence
  Peptide Derived from Human Papillomavirus
FVCPWCATN

SEQ ID NO: 50114 - protein, 9 aa, Artificial Sequence
  Peptide Derived from Human Papillomavirus
LCYEQLSES

SEQ ID NO: 50115 - protein, 9 aa, Artificial Sequence
  Peptide Derived from Human Papillomavirus
MAHNIIYGH

SEQ ID NO: 50116 - protein, 9 aa, Artificial Sequence
  Peptide Derived from Human Papillomavirus
MSYIHSMNS

SEQ ID NO: 50117 - protein, 9 aa, Artificial Sequence
  Peptide Derived from Human Papillomavirus
MGDTVPTDL

SEQ ID NO: 50118 - protein, 9 aa, Artificial Sequence
  Peptide Derived from Human Papillomavirus
VITQDVRDN

SEQ ID NO: 50119 - protein, 9 aa, Artificial Sequence
  Peptide Derived from Human Papillomavirus
YRVFRVALP

SEQ ID NO: 50120 - protein, 9 aa, Artificial Sequence
  Peptide Derived from Human Papillomavirus
LELKNTIIE

SEQ ID NO: 50121 - protein, 9 aa, Artificial Sequence
  Peptide Derived from Human Papillomavirus
VSRTSIFYH

SEQ ID NO: 50122 - protein, 9 aa, Artificial Sequence
  Peptide Derived from Human Papillomavirus
FIFQLCTIT

SEQ ID NO: 50123 - protein, 9 aa, Artificial Sequence
  Peptide Derived from Human Papillomavirus
IKGTSANMR

SEQ ID NO: 50124 - protein, 9 aa, Artificial Sequence
  Peptide Derived from Human Papillomavirus
IYNPETQRL

SEQ ID NO: 50125 - protein, 9 aa, Artificial Sequence
  Peptide Derived from Human Papillomavirus
VYLPPPSVA

SEQ ID NO: 50126 - protein, 9 aa, Artificial Sequence
  Peptide Derived from Human Papillomavirus
LDICQSICK

SEQ ID NO: 50127 - protein, 9 aa, Artificial Sequence
  Peptide Derived from Human Papillomavirus
LRREQLFAR

SEQ ID NO: 50128 - protein, 9 aa, Artificial Sequence
  Peptide Derived from Human Papillomavirus
MALWRPSDS

SEQ ID NO: 50129 - protein, 9 aa, Artificial Sequence
  Peptide Derived from Human Papillomavirus
FLQMALWRP

SEQ ID NO: 50130 - protein, 9 aa, Artificial Sequence
  Peptide Derived from Human Papillomavirus
LQDTKCEVP

SEQ ID NO: 50131 - protein, 9 aa, Artificial Sequence
  Peptide Derived from Human Papillomavirus
WAKGTLCKP

SEQ ID NO: 50132 - protein, 9 aa, Artificial Sequence
  Peptide Derived from Human Papillomavirus
IFLKNVNVF

SEQ ID NO: 50133 - protein, 9 aa, Artificial Sequence
  Peptide Derived from Human Papillomavirus
IGRGQPLGI

SEQ ID NO: 50134 - protein, 9 aa, Artificial Sequence
  Peptide Derived from Human Papillomavirus
YFRVVPSGA

SEQ ID NO: 50135 - protein, 9 aa, Artificial Sequence
  Peptide Derived from Human Papillomavirus
LGIGLSGHP

SEQ ID NO: 50136 - protein, 9 aa, Artificial Sequence
  Peptide Derived from Human Papillomavirus
VYSPSPSGS

SEQ ID NO: 50137 - protein, 9 aa, Artificial Sequence
  Peptide Derived from Human Papillomavirus
IYGHGIIIF

SEQ ID NO: 50138 - protein, 9 aa, Artificial Sequence
  Peptide Derived from Human Papillomavirus
LFVTVVDTT

SEQ ID NO: 50139 - protein, 9 aa, Artificial Sequence
  Peptide Derived from Human Papillomavirus
LCTITLTAE

SEQ ID NO: 50140 - protein, 9 aa, Artificial Sequence
  Peptide Derived from Human Papillomavirus
MNSSILENW

SEQ ID NO: 50141 - protein, 9 aa, Artificial Sequence
  Peptide Derived from Human Papillomavirus
LKNVNVFPI

SEQ ID NO: 50142 - protein, 9 aa, Artificial Sequence
  Peptide Derived from Human Papillomavirus
VPLDICQSI

SEQ ID NO: 50143 - protein, 9 aa, Artificial Sequence
  Peptide Derived from Human Papillomavirus
LPDSTIYNP

SEQ ID NO: 50144 - protein, 9 aa, Artificial Sequence
  Peptide Derived from Human Papillomavirus
FWTVDLKEK

SEQ ID NO: 50145 - protein, 9 aa, Artificial Sequence
  Peptide Derived from Human Papillomavirus
VPKVSAYQY

SEQ ID NO: 50146 - protein, 9 aa, Artificial Sequence
  Peptide Derived from Human Papillomavirus
LGCVPAIGE

SEQ ID NO: 50147 - protein, 9 aa, Artificial Sequence
  Peptide Derived from Human Papillomavirus
WNFGVPPPP

SEQ ID NO: 50148 - protein, 9 aa, Artificial Sequence
  Peptide Derived from Human Papillomavirus
VNVFPIFLQ

SEQ ID NO: 50149 - protein, 9 aa, Artificial Sequence
  Peptide Derived from Human Papillomavirus
IFQLCTITL

SEQ ID NO: 50150 - protein, 9 aa, Artificial Sequence
  Peptide Derived from Human Papillomavirus
WRPSDSTVY

SEQ ID NO: 50151 - protein, 9 aa, Artificial Sequence
  Peptide Derived from Human Papillomavirus
IHSMNSSIL

SEQ ID NO: 50152 - protein, 9 aa, Artificial Sequence
  Peptide Derived from Human Papillomavirus
VPPPPTTSL

SEQ ID NO: 50153 - protein, 9 aa, Artificial Sequence
  Peptide Derived from Human Papillomavirus
YGHGIIIFL

SEQ ID NO: 50154 - protein, 9 aa, Artificial Sequence
  Peptide Derived from Human Papillomavirus
YWLHKAQGH

SEQ ID NO: 50155 - protein, 9 aa, Artificial Sequence
  Peptide Derived from Human Papillomavirus
FRVVPSGAG

SEQ ID NO: 50156 - protein, 9 aa, Artificial Sequence
  Peptide Derived from Human Papillomavirus
IEDGDMVDT

SEQ ID NO: 50157 - protein, 9 aa, Artificial Sequence
  Peptide Derived from Human Papillomavirus
VFPIFLQMA

SEQ ID NO: 50158 - protein, 9 aa, Artificial Sequence
  Peptide Derived from Human Papillomavirus
VDYKQTQLC

SEQ ID NO: 50159 - protein, 9 aa, Artificial Sequence
  Peptide Derived from Human Papillomavirus
FGVPPPPTT

SEQ ID NO: 50160 - protein, 9 aa, Artificial Sequence
  Peptide Derived from Human Papillomavirus
LQPGDCPPL

SEQ ID NO: 50161 - protein, 9 aa, Artificial Sequence
  Peptide Derived from Human Papillomavirus
ICQSICKYP

SEQ ID NO: 50162 - protein, 9 aa, Artificial Sequence
  Peptide Derived from Human Papillomavirus
LKNTIIEDG

SEQ ID NO: 50163 - protein, 9 aa, Artificial Sequence
  Peptide Derived from Human Papillomavirus
FGLPDSTIY

SEQ ID NO: 50164 - protein, 9 aa, Artificial Sequence
  Peptide Derived from Human Papillomavirus
LYIKGTSAN

SEQ ID NO: 50165 - protein, 9 aa, Artificial Sequence
  Peptide Derived from Human Papillomavirus
LRRRPTIGP

SEQ ID NO: 50166 - protein, 9 aa, Artificial Sequence
  Peptide Derived from Human Papillomavirus
FQLCTITLT

SEQ ID NO: 50167 - protein, 9 aa, Artificial Sequence
  Peptide Derived from Human Papillomavirus
ILGCVPAIG

SEQ ID NO: 50168 - protein, 9 aa, Artificial Sequence
  Peptide Derived from Human Papillomavirus
VTVVDTTRS

SEQ ID NO: 50169 - protein, 9 aa, Artificial Sequence
  Peptide Derived from Human Papillomavirus
LCILGCVPA

SEQ ID NO: 50170 - protein, 9 aa, Artificial Sequence
  Peptide Derived from Human Papillomavirus
LGRKFLVQA

SEQ ID NO: 50171 - protein, 9 aa, Artificial Sequence
  Peptide Derived from Human Papillomavirus
VFRVALPDP

SEQ ID NO: 50172 - protein, 9 aa, Artificial Sequence
  Peptide Derived from Human Papillomavirus
VMGDTVPTD

SEQ ID NO: 50173 - protein, 9 aa, Artificial Sequence
  Peptide Derived from Human Papillomavirus
WNRAGVMGD

SEQ ID NO: 50174 - protein, 9 aa, Artificial Sequence
  Peptide Derived from Human Papillomavirus
LVQAGLRRR

SEQ ID NO: 50175 - protein, 9 aa, Artificial Sequence
  Peptide Derived from Human Papillomavirus
WACVGMEIG

SEQ ID NO: 50176 - protein, 9 aa, Artificial Sequence
  Peptide Derived from Human Papillomavirus
YSPSPSGSI

SEQ ID NO: 50177 - protein, 9 aa, Artificial Sequence
  Peptide Derived from Human Papillomavirus
ITTSDSQLF

SEQ ID NO: 50178 - protein, 9 aa, Artificial Sequence
  Peptide Derived from Human Papillomavirus
YHAGSSRLL

SEQ ID NO: 50179 - protein, 9 aa, Artificial Sequence
  Peptide Derived from Human Papillomavirus
VEEYDLQFI

SEQ ID NO: 50180 - protein, 9 aa, Artificial Sequence
  Peptide Derived from Human Papillomavirus
LTVGNPYFR

SEQ ID NO: 50181 - protein, 9 aa, Artificial Sequence
  Peptide Derived from Human Papillomavirus
LDQYPLGRK

SEQ ID NO: 50182 - protein, 9 aa, Artificial Sequence
  Peptide Derived from Human Papillomavirus
LTLCASTQN

SEQ ID NO: 50183 - protein, 9 aa, Artificial Sequence
  Peptide Derived from Human Papillomavirus
YLPPPSVAR

SEQ ID NO: 50184 - protein, 9 aa, Artificial Sequence
  Peptide Derived from Human Papillomavirus
YKQTQLCIL

SEQ ID NO: 50185 - protein, 9 aa, Artificial Sequence
  Peptide Derived from Human Papillomavirus
YVSRTSIFY

SEQ ID NO: 50186 - protein, 9 aa, Artificial Sequence
  Peptide Derived from Human Papillomavirus
YIKGTSANM

SEQ ID NO: 50187 - protein, 9 aa, Artificial Sequence
  Peptide Derived from Human Papillomavirus
LTAEVMSYI

SEQ ID NO: 50188 - protein, 9 aa, Artificial Sequence
  Peptide Derived from Human Papillomavirus
VRDNVSVDY

SEQ ID NO: 50189 - protein, 9 aa, Artificial Sequence
  Peptide Derived from Human Papillomavirus
LVWACVGME

SEQ ID NO: 50190 - protein, 9 aa, Artificial Sequence
  Peptide Derived from Human Papillomavirus
FYHAGSSRL

SEQ ID NO: 50191 - protein, 9 aa, Artificial Sequence
  Peptide Derived from Human Papillomavirus
LKEKFSSDL

SEQ ID NO: 50192 - protein, 9 aa, Artificial Sequence
  Peptide Derived from Human Papillomavirus
LPPPSVARV

SEQ ID NO: 50193 - protein, 9 aa, Artificial Sequence
  Peptide Derived from Human Papillomavirus
FVQSVAVTC

SEQ ID NO: 50194 - protein, 9 aa, Artificial Sequence
  Peptide Derived from Human Papillomavirus
YRFVQSVAV

SEQ ID NO: 50195 - protein, 9 aa, Artificial Sequence
  Peptide Derived from Human Papillomavirus
YDLQFIFQL

SEQ ID NO: 50196 - protein, 9 aa, Artificial Sequence
  Peptide Derived from Human Papillomavirus
IFLQMALWR

SEQ ID NO: 50197 - protein, 9 aa, Artificial Sequence
  Peptide Derived from Human Papillomavirus
VALPDPNKF

SEQ ID NO: 50198 - protein, 9 aa, Artificial Sequence
  Peptide Derived from Human Papillomavirus
IGEHWAKGT

SEQ ID NO: 50199 - protein, 9 aa, Artificial Sequence
  Peptide Derived from Human Papillomavirus
VDTTRSTNL

SEQ ID NO: 50200 - protein, 9 aa, Artificial Sequence
  Peptide Derived from Human Papillomavirus
LKFWTVDLK

SEQ ID NO: 50201 - protein, 9 aa, Artificial Sequence
  Peptide Derived from Human Papillomavirus
VVPSGAGNK

SEQ ID NO: 50202 - protein, 9 aa, Artificial Sequence
  Peptide Derived from Human Papillomavirus
MDFSTLQDT

SEQ ID NO: 50203 - protein, 9 aa, Artificial Sequence
  Peptide Derived from Human Papillomavirus
LDDTESAHA

SEQ ID NO: 50204 - protein, 9 aa, Artificial Sequence
  Peptide Derived from Human Papillomavirus
YLQMSADPY

SEQ ID NO: 50205 - protein, 9 aa, Artificial Sequence
  Peptide Derived from Human Papillomavirus
VQSVAVTCQ

SEQ ID NO: 50206 - protein, 9 aa, Artificial Sequence
  Peptide Derived from Human Papillomavirus
FRVALPDPN

SEQ ID NO: 50207 - protein, 9 aa, Artificial Sequence
  Peptide Derived from Human Papillomavirus
MVSHRAARR

SEQ ID NO: 50208 - protein, 9 aa, Artificial Sequence
  Peptide Derived from Human Papillomavirus
VSHRAARRK

SEQ ID NO: 50209 - protein, 9 aa, Artificial Sequence
  Peptide Derived from Human Papillomavirus
ILQWSSLGI

SEQ ID NO: 50210 - protein, 9 aa, Artificial Sequence
  Peptide Derived from Human Papillomavirus
YSNVTVPLT

SEQ ID NO: 50211 - protein, 9 aa, Artificial Sequence
  Peptide Derived from Human Papillomavirus
LPSHTPMWP

SEQ ID NO: 50212 - protein, 9 aa, Artificial Sequence
  Peptide Derived from Human Papillomavirus
LQWSSLGIF

SEQ ID NO: 50213 - protein, 9 aa, Artificial Sequence
  Peptide Derived from Human Papillomavirus
LFDVYADFP

SEQ ID NO: 50214 - protein, 9 aa, Artificial Sequence
  Peptide Derived from Human Papillomavirus
VVASGAPVP

SEQ ID NO: 50215 - protein, 9 aa, Artificial Sequence
  Peptide Derived from Human Papillomavirus
LSFEPTSNV

SEQ ID NO: 50216 - protein, 9 aa, Artificial Sequence
  Peptide Derived from Human Papillomavirus
LQPLISATN

SEQ ID NO: 50217 - protein, 9 aa, Artificial Sequence
  Peptide Derived from Human Papillomavirus
LQTFASSGS

SEQ ID NO: 50218 - protein, 9 aa, Artificial Sequence
  Peptide Derived from Human Papillomavirus
YADFPPPAS

SEQ ID NO: 50219 - protein, 9 aa, Artificial Sequence
  Peptide Derived from Human Papillomavirus
LGQRATMFT

SEQ ID NO: 50220 - protein, 9 aa, Artificial Sequence
  Peptide Derived from Human Papillomavirus
ITSSGTTTP

SEQ ID NO: 50221 - protein, 9 aa, Artificial Sequence
  Peptide Derived from Human Papillomavirus
LGGLGIGTG

SEQ ID NO: 50222 - protein, 9 aa, Artificial Sequence
  Peptide Derived from Human Papillomavirus
FVGTPTSGS

SEQ ID NO: 50223 - protein, 9 aa, Artificial Sequence
  Peptide Derived from Human Papillomavirus
LADKILQWS

SEQ ID NO: 50224 - protein, 9 aa, Artificial Sequence
  Peptide Derived from Human Papillomavirus
MWPSTSPTN

SEQ ID NO: 50225 - protein, 9 aa, Artificial Sequence
  Peptide Derived from Human Papillomavirus
VGPTDPSIV

SEQ ID NO: 50226 - protein, 9 aa, Artificial Sequence
  Peptide Derived from Human Papillomavirus
LHRPALSSR

SEQ ID NO: 50227 - protein, 9 aa, Artificial Sequence
  Peptide Derived from Human Papillomavirus
WSSLGIFLG

SEQ ID NO: 50228 - protein, 9 aa, Artificial Sequence
  Peptide Derived from Human Papillomavirus
VEGTTLADK

SEQ ID NO: 50229 - protein, 9 aa, Artificial Sequence
  Peptide Derived from Human Papillomavirus
LVEDSSVVA

SEQ ID NO: 50230 - protein, 9 aa, Artificial Sequence
  Peptide Derived from Human Papillomavirus
LTMPSTAAS

SEQ ID NO: 50231 - protein, 9 aa, Artificial Sequence
  Peptide Derived from Human Papillomavirus
VYADFPPPA

SEQ ID NO: 50232 - protein, 9 aa, Artificial Sequence
  Peptide Derived from Human Papillomavirus
FASSGSGTE

SEQ ID NO: 50233 - protein, 9 aa, Artificial Sequence
  Peptide Derived from Human Papillomavirus
WYYYFPKKR

SEQ ID NO: 50234 - protein, 9 aa, Artificial Sequence
  Peptide Derived from Human Papillomavirus
IRLHRPALS

SEQ ID NO: 50235 - protein, 9 aa, Artificial Sequence
  Peptide Derived from Human Papillomavirus
VGTPTSGSH

SEQ ID NO: 50236 - protein, 9 aa, Artificial Sequence
  Peptide Derived from Human Papillomavirus
FSDPSIIEV

SEQ ID NO: 50237 - protein, 9 aa, Artificial Sequence
  Peptide Derived from Human Papillomavirus
YEPLDTTLS

SEQ ID NO: 50238 - protein, 9 aa, Artificial Sequence
  Peptide Derived from Human Papillomavirus
VRVSTSQFL

SEQ ID NO: 50239 - protein, 9 aa, Artificial Sequence
  Peptide Derived from Human Papillomavirus
VDVGPTRPP

SEQ ID NO: 50240 - protein, 9 aa, Artificial Sequence
  Peptide Derived from Human Papillomavirus
VPLTSAWDV

SEQ ID NO: 50241 - protein, 9 aa, Artificial Sequence
  Peptide Derived from Human Papillomavirus
LDITPTVDS

SEQ ID NO: 50242 - protein, 9 aa, Artificial Sequence
  Peptide Derived from Human Papillomavirus
ILPSHTPMW

SEQ ID NO: 50243 - protein, 9 aa, Artificial Sequence
  Peptide Derived from Human Papillomavirus
IEVPQTGEV

SEQ ID NO: 50244 - protein, 9 aa, Artificial Sequence
  Peptide Derived from Human Papillomavirus
IHKSFTYPK

SEQ ID NO: 50245 - protein, 9 aa, Artificial Sequence
  Peptide Derived from Human Papillomavirus
IEPVGPTDP

SEQ ID NO: 50246 - protein, 9 aa, Artificial Sequence
  Peptide Derived from Human Papillomavirus
VRFSRLGQR

SEQ ID NO: 50247 - protein, 9 aa, Artificial Sequence
  Peptide Derived from Human Papillomavirus
IPYFFADGF

SEQ ID NO: 50248 - protein, 9 aa, Artificial Sequence
  Peptide Derived from Human Papillomavirus
VVIEPVGPT

SEQ ID NO: 50249 - protein, 9 aa, Artificial Sequence
  Peptide Derived from Human Papillomavirus
FYHDISPIA

SEQ ID NO: 50250 - protein, 9 aa, Artificial Sequence
  Peptide Derived from Human Papillomavirus
MDIIRLHRP

SEQ ID NO: 50251 - protein, 9 aa, Artificial Sequence
  Peptide Derived from Human Papillomavirus
YPKYSLTMP

SEQ ID NO: 50252 - protein, 9 aa, Artificial Sequence
  Peptide Derived from Human Papillomavirus
IFVGTPTSG

SEQ ID NO: 50253 - protein, 9 aa, Artificial Sequence
  Peptide Derived from Human Papillomavirus
YEEIPLQTF

SEQ ID NO: 50254 - protein, 9 aa, Artificial Sequence
  Peptide Derived from Human Papillomavirus
IFLGGLGIG

SEQ ID NO: 50255 - protein, 9 aa, Artificial Sequence
  Peptide Derived from Human Papillomavirus
MPSTAASSY

SEQ ID NO: 50256 - protein, 9 aa, Artificial Sequence
  Peptide Derived from Human Papillomavirus
VVDVGPTRP

SEQ ID NO: 50257 - protein, 9 aa, Artificial Sequence
  Peptide Derived from Human Papillomavirus
LTHPSSLVT

SEQ ID NO: 50258 - protein, 9 aa, Artificial Sequence
  Peptide Derived from Human Papillomavirus
VTFDNPAYE

SEQ ID NO: 50259 - protein, 9 aa, Artificial Sequence
  Peptide Derived from Human Papillomavirus
VASGAPVPT

SEQ ID NO: 50260 - protein, 9 aa, Artificial Sequence
  Peptide Derived from Human Papillomavirus
IELQPLISA

SEQ ID NO: 50261 - protein, 9 aa, Artificial Sequence
  Peptide Derived from Human Papillomavirus
ISSTPLPTV

SEQ ID NO: 50262 - protein, 9 aa, Artificial Sequence
  Peptide Derived from Human Papillomavirus
VLDITPTVD

SEQ ID NO: 50263 - protein, 9 aa, Artificial Sequence
  Peptide Derived from Human Papillomavirus
WPSTSPTNA

SEQ ID NO: 50264 - protein, 9 aa, Artificial Sequence
  Peptide Derived from Human Papillomavirus
VDSVSISST

SEQ ID NO: 50265 - protein, 9 aa, Artificial Sequence
  Peptide Derived from Human Papillomavirus
FEITSSGTT

SEQ ID NO: 50266 - protein, 9 aa, Artificial Sequence
  Peptide Derived from Human Papillomavirus
FLTHPSSLV

SEQ ID NO: 50267 - protein, 9 aa, Artificial Sequence
  Peptide Derived from Human Papillomavirus
IGIHGTQYY

SEQ ID NO: 50268 - protein, 9 aa, Artificial Sequence
  Peptide Derived from Human Papillomavirus
VSISSTSFT

SEQ ID NO: 50269 - protein, 9 aa, Artificial Sequence
  Peptide Derived from Human Papillomavirus
YHDISPIAA

SEQ ID NO: 50270 - protein, 9 aa, Artificial Sequence
  Peptide Derived from Human Papillomavirus
YTGPDIILP

SEQ ID NO: 50271 - protein, 9 aa, Artificial Sequence
  Peptide Derived from Human Papillomavirus
VRGPRLYSR

SEQ ID NO: 50272 - protein, 9 aa, Artificial Sequence
  Peptide Derived from Human Papillomavirus
VEDSSVVAS

SEQ ID NO: 50273 - protein, 9 aa, Artificial Sequence
  Peptide Derived from Human Papillomavirus
VGPTRPPVV

SEQ ID NO: 50274 - protein, 9 aa, Artificial Sequence
  Peptide Derived from Human Papillomavirus
FPPPASTTP

SEQ ID NO: 50275 - protein, 9 aa, Artificial Sequence
  Peptide Derived from Human Papillomavirus
LDTTLSFEP

SEQ ID NO: 50276 - protein, 9 aa, Artificial Sequence
  Peptide Derived from Human Papillomavirus
ISPIAATEE

SEQ ID NO: 50277 - protein, 9 aa, Artificial Sequence
  Peptide Derived from Human Papillomavirus
YSLTMPSTA

SEQ ID NO: 50278 - protein, 9 aa, Artificial Sequence
  Peptide Derived from Human Papillomavirus
VTVPLTSAW

SEQ ID NO: 50279 - protein, 9 aa, Artificial Sequence
  Peptide Derived from Human Papillomavirus
VPCLQVCKA

SEQ ID NO: 50280 - protein, 9 aa, Artificial Sequence
  Peptide Derived from Human Papillomavirus
FGCKNIWEV

SEQ ID NO: 50281 - protein, 9 aa, Artificial Sequence
  Peptide Derived from Human Papillomavirus
LWLTEPKKC

SEQ ID NO: 50282 - protein, 9 aa, Artificial Sequence
  Peptide Derived from Human Papillomavirus
IWEVHMENE

SEQ ID NO: 50283 - protein, 9 aa, Artificial Sequence
  Peptide Derived from Human Papillomavirus
VCKAKACSA

SEQ ID NO: 50284 - protein, 9 aa, Artificial Sequence
  Peptide Derived from Human Papillomavirus
IEVQIALES

SEQ ID NO: 50285 - protein, 9 aa, Artificial Sequence
  Peptide Derived from Human Papillomavirus
VDYRGIYYV

SEQ ID NO: 50286 - protein, 9 aa, Artificial Sequence
  Peptide Derived from Human Papillomavirus
WQKVCSGVD

SEQ ID NO: 50287 - protein, 9 aa, Artificial Sequence
  Peptide Derived from Human Papillomavirus
YCPDSVSST

SEQ ID NO: 50288 - protein, 9 aa, Artificial Sequence
  Peptide Derived from Human Papillomavirus
MENESIYCP

SEQ ID NO: 50289 - protein, 9 aa, Artificial Sequence
  Peptide Derived from Human Papillomavirus
IALESLSTT

SEQ ID NO: 50290 - protein, 9 aa, Artificial Sequence
  Peptide Derived from Human Papillomavirus
YKTLFVDVT

SEQ ID NO: 50291 - protein, 9 aa, Artificial Sequence
  Peptide Derived from Human Papillomavirus
VWFDGSKNN

SEQ ID NO: 50292 - protein, 9 aa, Artificial Sequence
  Peptide Derived from Human Papillomavirus
IYKDETQRN

SEQ ID NO: 50293 - protein, 9 aa, Artificial Sequence
  Peptide Derived from Human Papillomavirus
VVYRLVWDK

SEQ ID NO: 50294 - protein, 9 aa, Artificial Sequence
  Peptide Derived from Human Papillomavirus
FVDVTSTYH

SEQ ID NO: 50295 - protein, 9 aa, Artificial Sequence
  Peptide Derived from Human Papillomavirus
YYNGDCGWQ

SEQ ID NO: 50296 - protein, 9 aa, Artificial Sequence
  Peptide Derived from Human Papillomavirus
VKIPVVYRL

SEQ ID NO: 50297 - protein, 9 aa, Artificial Sequence
  Peptide Derived from Human Papillomavirus
VAWKYIYYN

SEQ ID NO: 50298 - protein, 9 aa, Artificial Sequence
  Peptide Derived from Human Papillomavirus
WTLRDTCEE

SEQ ID NO: 50299 - protein, 9 aa, Artificial Sequence
  Peptide Derived from Human Papillomavirus
IYCPDSVSS

SEQ ID NO: 50300 - protein, 9 aa, Artificial Sequence
  Peptide Derived from Human Papillomavirus
YSIITIIYK

SEQ ID NO: 50301 - protein, 9 aa, Artificial Sequence
  Peptide Derived from Human Papillomavirus
LSHVKIPVV

SEQ ID NO: 50302 - protein, 9 aa, Artificial Sequence
  Peptide Derived from Human Papillomavirus
LESLSTTIY

SEQ ID NO: 50303 - protein, 9 aa, Artificial Sequence
  Peptide Derived from Human Papillomavirus
VSPVETVNE

SEQ ID NO: 50304 - protein, 9 aa, Artificial Sequence
  Peptide Derived from Human Papillomavirus
FQKYKTLFV

SEQ ID NO: 50305 - protein, 9 aa, Artificial Sequence
  Peptide Derived from Human Papillomavirus
VGNQDAAVS

SEQ ID NO: 50306 - protein, 9 aa, Artificial Sequence
  Peptide Derived from Human Papillomavirus
YNVSPVETV

SEQ ID NO: 50307 - protein, 9 aa, Artificial Sequence
  Peptide Derived from Human Papillomavirus
VDVTSTYHW

SEQ ID NO: 50308 - protein, 9 aa, Artificial Sequence
  Peptide Derived from Human Papillomavirus
YHWTSTDNK

SEQ ID NO: 50309 - protein, 9 aa, Artificial Sequence
  Peptide Derived from Human Papillomavirus
VNEYNTHKT

SEQ ID NO: 50310 - protein, 9 aa, Artificial Sequence
  Peptide Derived from Human Papillomavirus
YNTHKTTTT

SEQ ID NO: 50311 - protein, 9 aa, Artificial Sequence
  Peptide Derived from Human Papillomavirus
LQVCKAKAC

SEQ ID NO: 50312 - protein, 9 aa, Artificial Sequence
  Peptide Derived from Human Papillomavirus
LFVDVTSTY

SEQ ID NO: 50313 - protein, 9 aa, Artificial Sequence
  Peptide Derived from Human Papillomavirus
YNFACTELK

SEQ ID NO: 50314 - protein, 9 aa, Artificial Sequence
  Peptide Derived from Human Papillomavirus
WTGSCLGCW

SEQ ID NO: 50315 - protein, 9 aa, Artificial Sequence
  Peptide Derived from Human Papillomavirus
YAVCRVCLL

SEQ ID NO: 50316 - protein, 9 aa, Artificial Sequence
  Peptide Derived from Human Papillomavirus
IRCYRCQSP

SEQ ID NO: 50317 - protein, 9 aa, Artificial Sequence
  Peptide Derived from Human Papillomavirus
LSCVYCKKE

SEQ ID NO: 50318 - protein, 9 aa, Artificial Sequence
  Peptide Derived from Human Papillomavirus
VYGATLESI

SEQ ID NO: 50319 - protein, 9 aa, Artificial Sequence
  Peptide Derived from Human Papillomavirus
LIDLRLSCV

SEQ ID NO: 50320 - protein, 9 aa, Artificial Sequence
  Peptide Derived from Human Papillomavirus
IAHGWTGSC

SEQ ID NO: 50321 - protein, 9 aa, Artificial Sequence
  Peptide Derived from Human Papillomavirus
IDLRLSCVY

SEQ ID NO: 50322 - protein, 9 aa, Artificial Sequence
  Peptide Derived from Human Papillomavirus
YRCQSPLTP

SEQ ID NO: 50323 - protein, 9 aa, Artificial Sequence
  Peptide Derived from Human Papillomavirus
LTRAEVYNF

SEQ ID NO: 50324 - protein, 9 aa, Artificial Sequence
  Peptide Derived from Human Papillomavirus
LCDLLIRCY

SEQ ID NO: 50325 - protein, 9 aa, Artificial Sequence
  Peptide Derived from Human Papillomavirus
YRDDFPYAV

SEQ ID NO: 50326 - protein, 9 aa, Artificial Sequence
  Peptide Derived from Human Papillomavirus
YYDYSVYGA

SEQ ID NO: 50327 - protein, 9 aa, Artificial Sequence
  Peptide Derived from Human Papillomavirus
ITKKQLCDL

SEQ ID NO: 50328 - protein, 9 aa, Artificial Sequence
  Peptide Derived from Human Papillomavirus
LRLSCVYCK

SEQ ID NO: 50329 - protein, 9 aa, Artificial Sequence
  Peptide Derived from Human Papillomavirus
VLEIPLIDL

SEQ ID NO: 50330 - protein, 9 aa, Artificial Sequence
  Peptide Derived from Human Papillomavirus
VCRVCLLFY

SEQ ID NO: 50331 - protein, 9 aa, Artificial Sequence
  Peptide Derived from Human Papillomavirus
VYNFACTEL

SEQ ID NO: 50332 - protein, 9 aa, Artificial Sequence
  Peptide Derived from Human Papillomavirus
FPYAVCRVC

SEQ ID NO: 50333 - protein, 9 aa, Artificial Sequence
  Peptide Derived from Human Papillomavirus
YCKKELTRA

SEQ ID NO: 50334 - protein, 9 aa, Artificial Sequence
  Peptide Derived from Human Papillomavirus
LEIPLIDLR

SEQ ID NO: 50335 - protein, 9 aa, Artificial Sequence
  Peptide Derived from Human Papillomavirus
LFYSKVRKY

SEQ ID NO: 50336 - protein, 9 aa, Artificial Sequence
  Peptide Derived from Human Papillomavirus
IPLIDLRLS

SEQ ID NO: 50337 - protein, 9 aa, Artificial Sequence
  Peptide Derived from Human Papillomavirus
FACTELKLV

SEQ ID NO: 50338 - protein, 9 aa, Artificial Sequence
  Peptide Derived from Human Papillomavirus
YSVYGATLE

SEQ ID NO: 50339 - protein, 9 aa, Artificial Sequence
  Peptide Derived from Human Papillomavirus
MHGKVPTLQ

SEQ ID NO: 50340 - protein, 9 aa, Artificial Sequence
  Peptide Derived from Human Papillomavirus
VTCPLCASS

SEQ ID NO: 50341 - protein, 9 aa, Artificial Sequence
  Peptide Derived from Human Papillomavirus
VVQLDIQST

SEQ ID NO: 50342 - protein, 9 aa, Artificial Sequence
  Peptide Derived from Human Papillomavirus
IHVPCCECK

SEQ ID NO: 50343 - protein, 9 aa, Artificial Sequence
  Peptide Derived from Human Papillomavirus
VVQQLLMGA

SEQ ID NO: 50344 - protein, 9 aa, Artificial Sequence
  Peptide Derived from Human Papillomavirus
YLIHVPCCE

SEQ ID NO: 50345 - protein, 9 aa, Artificial Sequence
  Peptide Derived from Human Papillomavirus
VPCCECKFV

SEQ ID NO: 50346 - protein, 9 aa, Artificial Sequence
  Peptide Derived from Human Papillomavirus
VVLELTPQT

SEQ ID NO: 50347 - protein, 9 aa, Artificial Sequence
  Peptide Derived from Human Papillomavirus
VQQLLMGAL

SEQ ID NO: 50348 - protein, 9 aa, Artificial Sequence
  Peptide Derived from Human Papillomavirus
LTVTCPLCA

SEQ ID NO: 50349 - protein, 9 aa, Artificial Sequence
  Peptide Derived from Human Papillomavirus
VLELTPQTE

SEQ ID NO: 50350 - protein, 9 aa, Artificial Sequence
  Peptide Derived from Human Papillomavirus
MGALTVTCP

SEQ ID NO: 50351 - protein, 9 aa, Artificial Sequence
  Peptide Derived from Human Papillomavirus
LMGALTVTC

SEQ ID NO: 50352 - protein, 9 aa, Artificial Sequence
  Peptide Derived from Human Papillomavirus
LIHVPCCEC

SEQ ID NO: 50353 - protein, 9 aa, Artificial Sequence
  Peptide Derived from Human Papillomavirus
LQDVVLELT

SEQ ID NO: 50354 - protein, 9 aa, Artificial Sequence
  Peptide Derived from Human Papillomavirus
LLMGALTVT

SEQ ID NO: 50355 - protein, 9 aa, Artificial Sequence
  Peptide Derived from Human Papillomavirus
LDIQSTKED

SEQ ID NO: 50356 - protein, 9 aa, Artificial Sequence
  Peptide Derived from Human Papillomavirus
MMLPMMYIY

SEQ ID NO: 50357 - protein, 9 aa, Artificial Sequence
  Peptide Derived from Human Papillomavirus
LPMMYIYRD

SEQ ID NO: 50358 - protein, 9 aa, Artificial Sequence
  Peptide Derived from Human Papillomavirus
VGETIPAEL

SEQ ID NO: 50359 - protein, 9 aa, Artificial Sequence
  Peptide Derived from Human Papillomavirus
LEDWNIGLS

SEQ ID NO: 50360 - protein, 9 aa, Artificial Sequence
  Peptide Derived from Human Papillomavirus
VFPIFLQMA

SEQ ID NO: 50361 - protein, 9 aa, Artificial Sequence
  Peptide Derived from Human Papillomavirus
YRVFRVRLP

SEQ ID NO: 50362 - protein, 9 aa, Artificial Sequence
  Peptide Derived from Human Papillomavirus
LDVGAVNVF

SEQ ID NO: 50363 - protein, 9 aa, Artificial Sequence
  Peptide Derived from Human Papillomavirus
LALINTPIE

SEQ ID NO: 50364 - protein, 9 aa, Artificial Sequence
  Peptide Derived from Human Papillomavirus
LHYGLCIFL

SEQ ID NO: 50365 - protein, 9 aa, Artificial Sequence
  Peptide Derived from Human Papillomavirus
VKRTSIFYH

SEQ ID NO: 50366 - protein, 9 aa, Artificial Sequence
  Peptide Derived from Human Papillomavirus
LQDSFSTDL

SEQ ID NO: 50367 - protein, 9 aa, Artificial Sequence
  Peptide Derived from Human Papillomavirus
IGLSPPVAT

SEQ ID NO: 50368 - protein, 9 aa, Artificial Sequence
  Peptide Derived from Human Papillomavirus
YRYVRSTAI

SEQ ID NO: 50369 - protein, 9 aa, Artificial Sequence
  Peptide Derived from Human Papillomavirus
FVFQLCKIT

SEQ ID NO: 50370 - protein, 9 aa, Artificial Sequence
  Peptide Derived from Human Papillomavirus
VYLPPTPVS

SEQ ID NO: 50371 - protein, 9 aa, Artificial Sequence
  Peptide Derived from Human Papillomavirus
LDIVQSTCK

SEQ ID NO: 50372 - protein, 9 aa, Artificial Sequence
  Peptide Derived from Human Papillomavirus
MDFKVLQES

SEQ ID NO: 50373 - protein, 9 aa, Artificial Sequence
  Peptide Derived from Human Papillomavirus
LQESKAEVP

SEQ ID NO: 50374 - protein, 9 aa, Artificial Sequence
  Peptide Derived from Human Papillomavirus
VGAVNVFPI

SEQ ID NO: 50375 - protein, 9 aa, Artificial Sequence
  Peptide Derived from Human Papillomavirus
MATWRPSEN

SEQ ID NO: 50376 - protein, 9 aa, Artificial Sequence
  Peptide Derived from Human Papillomavirus
LDDTESSNL

SEQ ID NO: 50377 - protein, 9 aa, Artificial Sequence
  Peptide Derived from Human Papillomavirus
FLQMATWRP

SEQ ID NO: 50378 - protein, 9 aa, Artificial Sequence
  Peptide Derived from Human Papillomavirus
VNLQDSFST

SEQ ID NO: 50379 - protein, 9 aa, Artificial Sequence
  Peptide Derived from Human Papillomavirus
LSGHPLFNR

SEQ ID NO: 50380 - protein, 9 aa, Artificial Sequence
  Peptide Derived from Human Papillomavirus
WTKGAVCKS

SEQ ID NO: 50381 - protein, 9 aa, Artificial Sequence
  Peptide Derived from Human Papillomavirus
VGRGQPLGA

SEQ ID NO: 50382 - protein, 9 aa, Artificial Sequence
  Peptide Derived from Human Papillomavirus
LFVTVVDTT

SEQ ID NO: 50383 - protein, 9 aa, Artificial Sequence
  Peptide Derived from Human Papillomavirus
LGAGLSGHP

SEQ ID NO: 50384 - protein, 9 aa, Artificial Sequence
  Peptide Derived from Human Papillomavirus
VPLDIVQST

SEQ ID NO: 50385 - protein, 9 aa, Artificial Sequence
  Peptide Derived from Human Papillomavirus
LPDTNIYNP

SEQ ID NO: 50386 - protein, 9 aa, Artificial Sequence
  Peptide Derived from Human Papillomavirus
LSAEVMAYL

SEQ ID NO: 50387 - protein, 9 aa, Artificial Sequence
  Peptide Derived from Human Papillomavirus
IPKVSAYQY

SEQ ID NO: 50388 - protein, 9 aa, Artificial Sequence
  Peptide Derived from Human Papillomavirus
LPPTPVSKV

SEQ ID NO: 50389 - protein, 9 aa, Artificial Sequence
  Peptide Derived from Human Papillomavirus
FWDVNLQDS

SEQ ID NO: 50390 - protein, 9 aa, Artificial Sequence
  Peptide Derived from Human Papillomavirus
YVRSTAITC

SEQ ID NO: 50391 - protein, 9 aa, Artificial Sequence
  Peptide Derived from Human Papillomavirus
YKFWDVNLQ

SEQ ID NO: 50392 - protein, 9 aa, Artificial Sequence
  Peptide Derived from Human Papillomavirus
FLDVGAVNV

SEQ ID NO: 50393 - protein, 9 aa, Artificial Sequence
  Peptide Derived from Human Papillomavirus
VGCTPAMGE

SEQ ID NO: 50394 - protein, 9 aa, Artificial Sequence
  Peptide Derived from Human Papillomavirus
WNIGLSPPV

SEQ ID NO: 50395 - protein, 9 aa, Artificial Sequence
  Peptide Derived from Human Papillomavirus
MNANLLEDW

SEQ ID NO: 50396 - protein, 9 aa, Artificial Sequence
  Peptide Derived from Human Papillomavirus
VEEYELQFV

SEQ ID NO: 50397 - protein, 9 aa, Artificial Sequence
  Peptide Derived from Human Papillomavirus
YDARKINQY

SEQ ID NO: 50398 - protein, 9 aa, Artificial Sequence
  Peptide Derived from Human Papillomavirus
LHNMNANLL

SEQ ID NO: 50399 - protein, 9 aa, Artificial Sequence
  Peptide Derived from Human Papillomavirus
IYRDPPLHY

SEQ ID NO: 50400 - protein, 9 aa, Artificial Sequence
  Peptide Derived from Human Papillomavirus
YRDPPLHYG

SEQ ID NO: 50401 - protein, 9 aa, Artificial Sequence
  Peptide Derived from Human Papillomavirus
LSPPVATSL

SEQ ID NO: 50402 - protein, 9 aa, Artificial Sequence
  Peptide Derived from Human Papillomavirus
VDGKQTQLC

SEQ ID NO: 50403 - protein, 9 aa, Artificial Sequence
  Peptide Derived from Human Papillomavirus
YWLQRAQGH

SEQ ID NO: 50404 - protein, 9 aa, Artificial Sequence
  Peptide Derived from Human Papillomavirus
YLPPTPVSK

SEQ ID NO: 50405 - protein, 9 aa, Artificial Sequence
  Peptide Derived from Human Papillomavirus
IEDGDMIDT

SEQ ID NO: 50406 - protein, 9 aa, Artificial Sequence
  Peptide Derived from Human Papillomavirus
LYLKGSNGR

SEQ ID NO: 50407 - protein, 9 aa, Artificial Sequence
  Peptide Derived from Human Papillomavirus
LINTPIEDG

SEQ ID NO: 50408 - protein, 9 aa, Artificial Sequence
  Peptide Derived from Human Papillomavirus
IVQSTCKYP

SEQ ID NO: 50409 - protein, 9 aa, Artificial Sequence
  Peptide Derived from Human Papillomavirus
YIYRDPPLH

SEQ ID NO: 50410 - protein, 9 aa, Artificial Sequence
  Peptide Derived from Human Papillomavirus
FGLPDTNIY

SEQ ID NO: 50411 - protein, 9 aa, Artificial Sequence
  Peptide Derived from Human Papillomavirus
VYVATPSGS

SEQ ID NO: 50412 - protein, 9 aa, Artificial Sequence
  Peptide Derived from Human Papillomavirus
VSKVVATDS

SEQ ID NO: 50413 - protein, 9 aa, Artificial Sequence
  Peptide Derived from Human Papillomavirus
LVWACVGLE

SEQ ID NO: 50414 - protein, 9 aa, Artificial Sequence
  Peptide Derived from Human Papillomavirus
LGRKFLMQL

SEQ ID NO: 50415 - protein, 9 aa, Artificial Sequence
  Peptide Derived from Human Papillomavirus
FQLCKITLS

SEQ ID NO: 50416 - protein, 9 aa, Artificial Sequence
  Peptide Derived from Human Papillomavirus
IVGCTPAMG

SEQ ID NO: 50417 - protein, 9 aa, Artificial Sequence
  Peptide Derived from Human Papillomavirus
VTVVDTTRS

SEQ ID NO: 50418 - protein, 9 aa, Artificial Sequence
  Peptide Derived from Human Papillomavirus
LCIVGCTPA

SEQ ID NO: 50419 - protein, 9 aa, Artificial Sequence
  Peptide Derived from Human Papillomavirus
VFRVRLPDP

SEQ ID NO: 50420 - protein, 9 aa, Artificial Sequence
  Peptide Derived from Human Papillomavirus
LMQLGTRSK

SEQ ID NO: 50421 - protein, 9 aa, Artificial Sequence
  Peptide Derived from Human Papillomavirus
WACVGLEVG

SEQ ID NO: 50422 - protein, 9 aa, Artificial Sequence
  Peptide Derived from Human Papillomavirus
MITSEAQLF

SEQ ID NO: 50423 - protein, 9 aa, Artificial Sequence
  Peptide Derived from Human Papillomavirus
YHAGSSRLL

SEQ ID NO: 50424 - protein, 9 aa, Artificial Sequence
  Peptide Derived from Human Papillomavirus
LAVGHPYYS

SEQ ID NO: 50425 - protein, 9 aa, Artificial Sequence
  Peptide Derived from Human Papillomavirus
LANNNVIED

SEQ ID NO: 50426 - protein, 9 aa, Artificial Sequence
  Peptide Derived from Human Papillomavirus
YVATPSGSM

SEQ ID NO: 50427 - protein, 9 aa, Artificial Sequence
  Peptide Derived from Human Papillomavirus
LDQFPLGRK

SEQ ID NO: 50428 - protein, 9 aa, Artificial Sequence
  Peptide Derived from Human Papillomavirus
MTISTATEQ

SEQ ID NO: 50429 - protein, 9 aa, Artificial Sequence
  Peptide Derived from Human Papillomavirus
VTTGDCPPL

SEQ ID NO: 50430 - protein, 9 aa, Artificial Sequence
  Peptide Derived from Human Papillomavirus
YVKRTSIFY

SEQ ID NO: 50431 - protein, 9 aa, Artificial Sequence
  Peptide Derived from Human Papillomavirus
LSKYDARKI

SEQ ID NO: 50432 - protein, 9 aa, Artificial Sequence
  Peptide Derived from Human Papillomavirus
MGEHWTKGA

SEQ ID NO: 50433 - protein, 9 aa, Artificial Sequence
  Peptide Derived from Human Papillomavirus
FYHAGSSRL

SEQ ID NO: 50434 - protein, 9 aa, Artificial Sequence
  Peptide Derived from Human Papillomavirus
YELQFVFQL

SEQ ID NO: 50435 - protein, 9 aa, Artificial Sequence
  Peptide Derived from Human Papillomavirus
IFLQMATWR

SEQ ID NO: 50436 - protein, 9 aa, Artificial Sequence
  Peptide Derived from Human Papillomavirus
LCKITLSAE

SEQ ID NO: 50437 - protein, 9 aa, Artificial Sequence
  Peptide Derived from Human Papillomavirus
VRLPDPNKF

SEQ ID NO: 50438 - protein, 9 aa, Artificial Sequence
  Peptide Derived from Human Papillomavirus
VNVFPIFLQ

SEQ ID NO: 50439 - protein, 9 aa, Artificial Sequence
  Peptide Derived from Human Papillomavirus
VVATDSYVK

SEQ ID NO: 50440 - protein, 9 aa, Artificial Sequence
  Peptide Derived from Human Papillomavirus
VDTTRSTNM

SEQ ID NO: 50441 - protein, 9 aa, Artificial Sequence
  Peptide Derived from Human Papillomavirus
LRREQLFAR

SEQ ID NO: 50442 - protein, 9 aa, Artificial Sequence
  Peptide Derived from Human Papillomavirus
YLKMSADAY

SEQ ID NO: 50443 - protein, 9 aa, Artificial Sequence
  Peptide Derived from Human Papillomavirus
FRVRLPDPN

SEQ ID NO: 50444 - protein, 9 aa, Artificial Sequence
  Peptide Derived from Human Papillomavirus
VRSTAITCQ

SEQ ID NO: 50445 - protein, 9 aa, Artificial Sequence
  Peptide Derived from Human Papillomavirus
VTKDNTKTN

SEQ ID NO: 50446 - protein, 9 aa, Artificial Sequence
  Peptide Derived from Human Papillomavirus
MVAHRATRR

SEQ ID NO: 50447 - protein, 9 aa, Artificial Sequence
  Peptide Derived from Human Papillomavirus
VAHRATRRK

SEQ ID NO: 50448 - protein, 9 aa, Artificial Sequence
  Peptide Derived from Human Papillomavirus
ILQWGSLFT

SEQ ID NO: 50449 - protein, 9 aa, Artificial Sequence
  Peptide Derived from Human Papillomavirus
IEMQPLLSA

SEQ ID NO: 50450 - protein, 9 aa, Artificial Sequence
  Peptide Derived from Human Papillomavirus
LSSQSVATP

SEQ ID NO: 50451 - protein, 9 aa, Artificial Sequence
  Peptide Derived from Human Papillomavirus
VSADNPLFE

SEQ ID NO: 50452 - protein, 9 aa, Artificial Sequence
  Peptide Derived from Human Papillomavirus
LPTGPSTWP

SEQ ID NO: 50453 - protein, 9 aa, Artificial Sequence
  Peptide Derived from Human Papillomavirus
LQWGSLFTY

SEQ ID NO: 50454 - protein, 9 aa, Artificial Sequence
  Peptide Derived from Human Papillomavirus
FLDRPATLV

SEQ ID NO: 50455 - protein, 9 aa, Artificial Sequence
  Peptide Derived from Human Papillomavirus
FMNIVALHR

SEQ ID NO: 50456 - protein, 9 aa, Artificial Sequence
  Peptide Derived from Human Papillomavirus
LAFSPSGVA

SEQ ID NO: 50457 - protein, 9 aa, Artificial Sequence
  Peptide Derived from Human Papillomavirus
MQPLLSANN

SEQ ID NO: 50458 - protein, 9 aa, Artificial Sequence
  Peptide Derived from Human Papillomavirus
MQTFAVHGS

SEQ ID NO: 50459 - protein, 9 aa, Artificial Sequence
  Peptide Derived from Human Papillomavirus
VIESGAGIP

SEQ ID NO: 50460 - protein, 9 aa, Artificial Sequence
  Peptide Derived from Human Papillomavirus
LYDIYANID

SEQ ID NO: 50461 - protein, 9 aa, Artificial Sequence
  Peptide Derived from Human Papillomavirus
VKVTDPAFL

SEQ ID NO: 50462 - protein, 9 aa, Artificial Sequence
  Peptide Derived from Human Papillomavirus
IAAPRLYRK

SEQ ID NO: 50463 - protein, 9 aa, Artificial Sequence
  Peptide Derived from Human Papillomavirus
LGRKATIQT

SEQ ID NO: 50464 - protein, 9 aa, Artificial Sequence
  Peptide Derived from Human Papillomavirus
FGGLGIGTG

SEQ ID NO: 50465 - protein, 9 aa, Artificial Sequence
  Peptide Derived from Human Papillomavirus
ITSSSTTTP

SEQ ID NO: 50466 - protein, 9 aa, Artificial Sequence
  Peptide Derived from Human Papillomavirus
LISTPTSGI

SEQ ID NO: 50467 - protein, 9 aa, Artificial Sequence
  Peptide Derived from Human Papillomavirus
FALWPVYFF

SEQ ID NO: 50468 - protein, 9 aa, Artificial Sequence
  Peptide Derived from Human Papillomavirus
YIQGSSFAL

SEQ ID NO: 50469 - protein, 9 aa, Artificial Sequence
  Peptide Derived from Human Papillomavirus
IKPSTLSFA

SEQ ID NO: 50470 - protein, 9 aa, Artificial Sequence
  Peptide Derived from Human Papillomavirus
YDISPIAQA

SEQ ID NO: 50471 - protein, 9 aa, Artificial Sequence
  Peptide Derived from Human Papillomavirus
YEEIPMQTF

SEQ ID NO: 50472 - protein, 9 aa, Artificial Sequence
  Peptide Derived from Human Papillomavirus
WGSLFTYFG

SEQ ID NO: 50473 - protein, 9 aa, Artificial Sequence
  Peptide Derived from Human Papillomavirus
FRRIAAPRL

SEQ ID NO: 50474 - protein, 9 aa, Artificial Sequence
  Peptide Derived from Human Papillomavirus
VTPARPPIV

SEQ ID NO: 50475 - protein, 9 aa, Artificial Sequence
  Peptide Derived from Human Papillomavirus
LVEESSVIE

SEQ ID NO: 50476 - protein, 9 aa, Artificial Sequence
  Peptide Derived from Human Papillomavirus
VALHRPAFT

SEQ ID NO: 50477 - protein, 9 aa, Artificial Sequence
  Peptide Derived from Human Papillomavirus
FAVHGSGTE

SEQ ID NO: 50478 - protein, 9 aa, Artificial Sequence
  Peptide Derived from Human Papillomavirus
ISTPTSGIH

SEQ ID NO: 50479 - protein, 9 aa, Artificial Sequence
  Peptide Derived from Human Papillomavirus
FEGTDTSLA

SEQ ID NO: 50480 - protein, 9 aa, Artificial Sequence
  Peptide Derived from Human Papillomavirus
FIDPPVIEA

SEQ ID NO: 50481 - protein, 9 aa, Artificial Sequence
  Peptide Derived from Human Papillomavirus
LDRPATLVS

SEQ ID NO: 50482 - protein, 9 aa, Artificial Sequence
  Peptide Derived from Human Papillomavirus
LDITPTSST

SEQ ID NO: 50483 - protein, 9 aa, Artificial Sequence
  Peptide Derived from Human Papillomavirus
MNIVALHRP

SEQ ID NO: 50484 - protein, 9 aa, Artificial Sequence
  Peptide Derived from Human Papillomavirus
VLPTGPSTW

SEQ ID NO: 50485 - protein, 9 aa, Artificial Sequence
  Peptide Derived from Human Papillomavirus
VESVGPTDP

SEQ ID NO: 50486 - protein, 9 aa, Artificial Sequence
  Peptide Derived from Human Papillomavirus
IDPPVIEAP

SEQ ID NO: 50487 - protein, 9 aa, Artificial Sequence
  Peptide Derived from Human Papillomavirus
IEAPQTGEV

SEQ ID NO: 50488 - protein, 9 aa, Artificial Sequence
  Peptide Derived from Human Papillomavirus
IVDVTPARP

SEQ ID NO: 50489 - protein, 9 aa, Artificial Sequence
  Peptide Derived from Human Papillomavirus
WADKILQWG

SEQ ID NO: 50490 - protein, 9 aa, Artificial Sequence
  Peptide Derived from Human Papillomavirus
LSANNSFDG

SEQ ID NO: 50491 - protein, 9 aa, Artificial Sequence
  Peptide Derived from Human Papillomavirus
YVPLGSRPS

SEQ ID NO: 50492 - protein, 9 aa, Artificial Sequence
  Peptide Derived from Human Papillomavirus
VRFSRLGRK

SEQ ID NO: 50493 - protein, 9 aa, Artificial Sequence
  Peptide Derived from Human Papillomavirus
FQQVKVTDP

SEQ ID NO: 50494 - protein, 9 aa, Artificial Sequence
  Peptide Derived from Human Papillomavirus
IPYFFADGD

SEQ ID NO: 50495 - protein, 9 aa, Artificial Sequence
  Peptide Derived from Human Papillomavirus
IVVESVGPT

SEQ ID NO: 50496 - protein, 9 aa, Artificial Sequence
  Peptide Derived from Human Papillomavirus
YYYDISPIA

SEQ ID NO: 50497 - protein, 9 aa, Artificial Sequence
  Peptide Derived from Human Papillomavirus
LPIKPSTLS

SEQ ID NO: 50498 - protein, 9 aa, Artificial Sequence
  Peptide Derived from Human Papillomavirus
FEITSSSTT

SEQ ID NO: 50499 - protein, 9 aa, Artificial Sequence
  Peptide Derived from Human Papillomavirus
ILISTPTSG

SEQ ID NO: 50500 - protein, 9 aa, Artificial Sequence
  Peptide Derived from Human Papillomavirus
FSPSGVAPD

SEQ ID NO: 50501 - protein, 9 aa, Artificial Sequence
  Peptide Derived from Human Papillomavirus
VATPSAHLP

SEQ ID NO: 50502 - protein, 9 aa, Artificial Sequence
  Peptide Derived from Human Papillomavirus
VHVSSTHIT

SEQ ID NO: 50503 - protein, 9 aa, Artificial Sequence
  Peptide Derived from Human Papillomavirus
VDVTPARPP

SEQ ID NO: 50504 - protein, 9 aa, Artificial Sequence
  Peptide Derived from Human Papillomavirus
LSGTCPEDV

SEQ ID NO: 50505 - protein, 9 aa, Artificial Sequence
  Peptide Derived from Human Papillomavirus
ISSTPIPGF

SEQ ID NO: 50506 - protein, 9 aa, Artificial Sequence
  Peptide Derived from Human Papillomavirus
VHGSGTEPI

SEQ ID NO: 50507 - protein, 9 aa, Artificial Sequence
  Peptide Derived from Human Papillomavirus
VSGNILIST

SEQ ID NO: 50508 - protein, 9 aa, Artificial Sequence
  Peptide Derived from Human Papillomavirus
VYIQGSSFA

SEQ ID NO: 50509 - protein, 9 aa, Artificial Sequence
  Peptide Derived from Human Papillomavirus
FASNTTNVT

SEQ ID NO: 50510 - protein, 9 aa, Artificial Sequence
  Peptide Derived from Human Papillomavirus
LFIDPPVIE

SEQ ID NO: 50511 - protein, 9 aa, Artificial Sequence
  Peptide Derived from Human Papillomavirus
VLDITPTSS

SEQ ID NO: 50512 - protein, 9 aa, Artificial Sequence
  Peptide Derived from Human Papillomavirus
YSGPDIVLP

SEQ ID NO: 50513 - protein, 9 aa, Artificial Sequence
  Peptide Derived from Human Papillomavirus
YKTCKLSGT

SEQ ID NO: 50514 - protein, 9 aa, Artificial Sequence
  Peptide Derived from Human Papillomavirus
VSSTHITNP

SEQ ID NO: 50515 - protein, 9 aa, Artificial Sequence
  Peptide Derived from Human Papillomavirus
FVPQSPYDV

SEQ ID NO: 50516 - protein, 9 aa, Artificial Sequence
  Peptide Derived from Human Papillomavirus
VGPTDPSIV

SEQ ID NO: 50517 - protein, 9 aa, Artificial Sequence
  Peptide Derived from Human Papillomavirus
YYDISPIAQ

SEQ ID NO: 50518 - protein, 9 aa, Artificial Sequence
  Peptide Derived from Human Papillomavirus
ITPTSSTVH

SEQ ID NO: 50519 - protein, 9 aa, Artificial Sequence
  Peptide Derived from Human Papillomavirus
VEESSVIES

SEQ ID NO: 50520 - protein, 9 aa, Artificial Sequence
  Peptide Derived from Human Papillomavirus
IDDEAPGLS

SEQ ID NO: 50521 - protein, 9 aa, Artificial Sequence
  Peptide Derived from Human Papillomavirus
LGSRPSTIV

SEQ ID NO: 50522 - protein, 15 aa, Artificial Sequence
  Peptide Derived from Human Papillomavirus
CWNYIDDNLRNALDG

SEQ ID NO: 50523 - protein, 15 aa, Artificial Sequence
  Peptide Derived from Human Papillomavirus
DNDIVDDSEIAYKYA

SEQ ID NO: 50524 - protein, 15 aa, Artificial Sequence
  Peptide Derived from Human Papillomavirus
GDAISDDENENDSDT

SEQ ID NO: 50525 - protein, 15 aa, Artificial Sequence
  Peptide Derived from Human Papillomavirus
ISEVYGDTPEWIQRQ

SEQ ID NO: 50526 - protein, 15 aa, Artificial Sequence
  Peptide Derived from Human Papillomavirus
KIGMLDDATVPCWNY

SEQ ID NO: 50527 - protein, 15 aa, Artificial Sequence
  Peptide Derived from Human Papillomavirus
LKAICIEKQSRAAKR

SEQ ID NO: 50528 - protein, 15 aa, Artificial Sequence
  Peptide Derived from Human Papillomavirus
NGWFYVEAVVEKKTG

SEQ ID NO: 50529 - protein, 15 aa, Artificial Sequence
  Peptide Derived from Human Papillomavirus
PMCMMIEPPKLRSTA

SEQ ID NO: 50530 - protein, 15 aa, Artificial Sequence
  Peptide Derived from Human Papillomavirus
PNEFPFDENGNPVYE

SEQ ID NO: 50531 - protein, 15 aa, Artificial Sequence
  Peptide Derived from Human Papillomavirus
QAKIVKDCATMCRHY

SEQ ID NO: 50532 - protein, 15 aa, Artificial Sequence
  Peptide Derived from Human Papillomavirus
QWAYDNDIVDDSEIA

SEQ ID NO: 50533 - protein, 15 aa, Artificial Sequence
  Peptide Derived from Human Papillomavirus
RLSLHEDEDKENDGD

SEQ ID NO: 50534 - protein, 15 aa, Artificial Sequence
  Peptide Derived from Human Papillomavirus
RRLFESEDSGYGNTE

SEQ ID NO: 50535 - protein, 15 aa, Artificial Sequence
  Peptide Derived from Human Papillomavirus
VDFIVNDNDYLTQAE

SEQ ID NO: 50536 - protein, 15 aa, Artificial Sequence
  Peptide Derived from Human Papillomavirus
VFTFPNEFPFDENGN

SEQ ID NO: 50537 - protein, 15 aa, Artificial Sequence
  Peptide Derived from Human Papillomavirus
WIKYRCDRVDDGGDW

SEQ ID NO: 50538 - protein, 15 aa, Artificial Sequence
  Peptide Derived from Human Papillomavirus
AVALGTEETQTTIQR

SEQ ID NO: 50539 - protein, 15 aa, Artificial Sequence
  Peptide Derived from Human Papillomavirus
ELQLTLETIYNSQYS

SEQ ID NO: 50540 - protein, 15 aa, Artificial Sequence
  Peptide Derived from Human Papillomavirus
EVQFDGDICNTMHYT

SEQ ID NO: 50541 - protein, 15 aa, Artificial Sequence
  Peptide Derived from Human Papillomavirus
FVQFKDDAEKYSKNK

SEQ ID NO: 50542 - protein, 15 aa, Artificial Sequence
  Peptide Derived from Human Papillomavirus
GLYYVHEGIRTYFVQ

SEQ ID NO: 50543 - protein, 15 aa, Artificial Sequence
  Peptide Derived from Human Papillomavirus
HIYICEEASVTVVEG

SEQ ID NO: 50544 - protein, 15 aa, Artificial Sequence
  Peptide Derived from Human Papillomavirus
IVHLKGDANTLKCLR

SEQ ID NO: 50545 - protein, 15 aa, Artificial Sequence
  Peptide Derived from Human Papillomavirus
IVTLTYDSEWQRDQF

SEQ ID NO: 50546 - protein, 15 aa, Artificial Sequence
  Peptide Derived from Human Papillomavirus
KHGYTVEVQFDGDIC

SEQ ID NO: 50547 - protein, 15 aa, Artificial Sequence
  Peptide Derived from Human Papillomavirus
LQDVSLEVYLTAPTG

SEQ ID NO: 50548 - protein, 15 aa, Artificial Sequence
  Peptide Derived from Human Papillomavirus
LTHYENDSTDLRDHI

SEQ ID NO: 50549 - protein, 15 aa, Artificial Sequence
  Peptide Derived from Human Papillomavirus
NSQYSNEKWTLQDVS

SEQ ID NO: 50550 - protein, 15 aa, Artificial Sequence
  Peptide Derived from Human Papillomavirus
RLNVCQDKILTHYEN

SEQ ID NO: 50551 - protein, 15 aa, Artificial Sequence
  Peptide Derived from Human Papillomavirus
THIYICEEASVTVVE

SEQ ID NO: 50552 - protein, 15 aa, Artificial Sequence
  Peptide Derived from Human Papillomavirus
TKLLHRDSVDSAPIL

SEQ ID NO: 50553 - protein, 15 aa, Artificial Sequence
  Peptide Derived from Human Papillomavirus
TLTYDSEWQRDQFLS

SEQ ID NO: 50554 - protein, 15 aa, Artificial Sequence
  Peptide Derived from Human Papillomavirus
TVEVQFDGDICNTMH

SEQ ID NO: 50555 - protein, 15 aa, Artificial Sequence
  Peptide Derived from Human Papillomavirus
WKHMRLECAIYYKAR

SEQ ID NO: 50556 - protein, 15 aa, Artificial Sequence
  Peptide Derived from Human Papillomavirus
IHDIILECVYCKQQL

SEQ ID NO: 50557 - protein, 15 aa, Artificial Sequence
  Peptide Derived from Human Papillomavirus
LCIVYRDGNPYAVCD

SEQ ID NO: 50558 - protein, 15 aa, Artificial Sequence
  Peptide Derived from Human Papillomavirus
LPQLCTELQTTIHDI

SEQ ID NO: 50559 - protein, 15 aa, Artificial Sequence
  Peptide Derived from Human Papillomavirus
QQLLRREVYDFAFRD

SEQ ID NO: 50560 - protein, 15 aa, Artificial Sequence
  Peptide Derived from Human Papillomavirus
RTAMFQDPQERPRKL

SEQ ID NO: 50561 - protein, 12 aa, Artificial Sequence
  Peptide Derived from Human Papillomavirus
MHGDTPTLHEYM

SEQ ID NO: 50562 - protein, 15 aa, Artificial Sequence
  Peptide Derived from Human Papillomavirus
LHEYMLDLQPETTDL

SEQ ID NO: 50563 - protein, 15 aa, Artificial Sequence
  Peptide Derived from Human Papillomavirus
MLDLQPETTDLYCYE

SEQ ID NO: 50564 - protein, 15 aa, Artificial Sequence
  Peptide Derived from Human Papillomavirus
TDLYCYEQLNDSSEE

SEQ ID NO: 50565 - protein, 15 aa, Artificial Sequence
  Peptide Derived from Human Papillomavirus
FFYLRREQMFVRHLF

SEQ ID NO: 50566 - protein, 15 aa, Artificial Sequence
  Peptide Derived from Human Papillomavirus
GENVPDDLYIKGSGS

SEQ ID NO: 50567 - protein, 15 aa, Artificial Sequence
  Peptide Derived from Human Papillomavirus
GSMVTSDAQIFNKPY

SEQ ID NO: 50568 - protein, 15 aa, Artificial Sequence
  Peptide Derived from Human Papillomavirus
INTVIQDGDMVDTGF

SEQ ID NO: 50569 - protein, 15 aa, Artificial Sequence
  Peptide Derived from Human Papillomavirus
ITCYENDVNVYHIFF

SEQ ID NO: 50570 - protein, 15 aa, Artificial Sequence
  Peptide Derived from Human Papillomavirus
KEKFSADLDQFPLGR

SEQ ID NO: 50571 - protein, 15 aa, Artificial Sequence
  Peptide Derived from Human Papillomavirus
KITLTADVMTYIHSM

SEQ ID NO: 50572 - protein, 15 aa, Artificial Sequence
  Peptide Derived from Human Papillomavirus
KSEVPLDICTSICKY

SEQ ID NO: 50573 - protein, 15 aa, Artificial Sequence
  Peptide Derived from Human Papillomavirus
NSTILEDWNFGLQPP

SEQ ID NO: 50574 - protein, 15 aa, Artificial Sequence
  Peptide Derived from Human Papillomavirus
SKVVSTDEYVARTNI

SEQ ID NO: 50575 - protein, 15 aa, Artificial Sequence
  Peptide Derived from Human Papillomavirus
SLWLPSEATVYLPPV

SEQ ID NO: 50576 - protein, 15 aa, Artificial Sequence
  Peptide Derived from Human Papillomavirus
TSFYNPDTQRLVWAC

SEQ ID NO: 50577 - protein, 15 aa, Artificial Sequence
  Peptide Derived from Human Papillomavirus
WACVGVEVGRGQPLG

SEQ ID NO: 50578 - protein, 15 aa, Artificial Sequence
  Peptide Derived from Human Papillomavirus
YIKMVSEPYGDSLFF

SEQ ID NO: 50579 - protein, 15 aa, Artificial Sequence
  Peptide Derived from Human Papillomavirus
ADDFITDTSTTPVPS

SEQ ID NO: 50580 - protein, 15 aa, Artificial Sequence
  Peptide Derived from Human Papillomavirus
IVSLVEETSFIDAGA

SEQ ID NO: 50581 - protein, 15 aa, Artificial Sequence
  Peptide Derived from Human Papillomavirus
KVHYYYDFSTIDSAE

SEQ ID NO: 50582 - protein, 12 aa, Artificial Sequence
  Peptide Derived from Human Papillomavirus
LPYFFSDVSLAA

SEQ ID NO: 50583 - protein, 15 aa, Artificial Sequence
  Peptide Derived from Human Papillomavirus
LYDIYADDFITDTST

SEQ ID NO: 50584 - protein, 15 aa, Artificial Sequence
  Peptide Derived from Human Papillomavirus
QYTIIADAGDFYLHP

SEQ ID NO: 50585 - protein, 15 aa, Artificial Sequence
  Peptide Derived from Human Papillomavirus
RPPLTVDPVGPSDPS

SEQ ID NO: 50586 - protein, 15 aa, Artificial Sequence
  Peptide Derived from Human Papillomavirus
SINIAPDPDFLDIVA

SEQ ID NO: 50587 - protein, 15 aa, Artificial Sequence
  Peptide Derived from Human Papillomavirus
TKLITYDNPAYEGID

SEQ ID NO: 50588 - protein, 15 aa, Artificial Sequence
  Peptide Derived from Human Papillomavirus
VPSIPPDVSGFSITT

SEQ ID NO: 50589 - protein, 15 aa, Artificial Sequence
  Peptide Derived from Human Papillomavirus
YDIYADDFITDTSTT

SEQ ID NO: 50590 - protein, 15 aa, Artificial Sequence
  Peptide Derived from Human Papillomavirus
YEEIPMDTFIVSTNP

SEQ ID NO: 50591 - protein, 15 aa, Artificial Sequence
  Peptide Derived from Human Papillomavirus
YEGIDVDNTLYFSSN

SEQ ID NO: 50592 - protein, 15 aa, Artificial Sequence
  Peptide Derived from Human Papillomavirus
AQEVHNDAQVLHVLK

SEQ ID NO: 50593 - protein, 15 aa, Artificial Sequence
  Peptide Derived from Human Papillomavirus
DNELTDESDMAFEYA

SEQ ID NO: 50594 - protein, 15 aa, Artificial Sequence
  Peptide Derived from Human Papillomavirus
ESDMAFEYALLADSN

SEQ ID NO: 50595 - protein, 15 aa, Artificial Sequence
  Peptide Derived from Human Papillomavirus
EYALLADSNSNAAAF

SEQ ID NO: 50596 - protein, 15 aa, Artificial Sequence
  Peptide Derived from Human Papillomavirus
GDVISDDEDENATDT

SEQ ID NO: 50597 - protein, 15 aa, Artificial Sequence
  Peptide Derived from Human Papillomavirus
GERLEVDTELSPRLQ

SEQ ID NO: 50598 - protein, 15 aa, Artificial Sequence
  Peptide Derived from Human Papillomavirus
ISEVMGDTPEWIQRL

SEQ ID NO: 50599 - protein, 15 aa, Artificial Sequence
  Peptide Derived from Human Papillomavirus
KVAMLDDATTTCWTY

SEQ ID NO: 50600 - protein, 15 aa, Artificial Sequence
  Peptide Derived from Human Papillomavirus
MLAVFKDTYGLSFTD

SEQ ID NO: 50601 - protein, 15 aa, Artificial Sequence
  Peptide Derived from Human Papillomavirus
PNAFPFDKNGNPVYE

SEQ ID NO: 50602 - protein, 15 aa, Artificial Sequence
  Peptide Derived from Human Papillomavirus
QAKYLKDCATMCKHY

SEQ ID NO: 50603 - protein, 15 aa, Artificial Sequence
  Peptide Derived from Human Papillomavirus
QWAFDNELTDESDMA

SEQ ID NO: 50604 - protein, 15 aa, Artificial Sequence
  Peptide Derived from Human Papillomavirus
RLDLHEEEEDADTEG

SEQ ID NO: 50605 - protein, 15 aa, Artificial Sequence
  Peptide Derived from Human Papillomavirus
RLEVDTELSPRLQEI

SEQ ID NO: 50606 - protein, 15 aa, Artificial Sequence
  Peptide Derived from Human Papillomavirus
TGDVISDDEDENATD

SEQ ID NO: 50607 - protein, 15 aa, Artificial Sequence
  Peptide Derived from Human Papillomavirus
TSHFWLEPLTDTKVA

SEQ ID NO: 50608 - protein, 15 aa, Artificial Sequence
  Peptide Derived from Human Papillomavirus
VRNFKSDKTTCTDWV

SEQ ID NO: 50609 - protein, 15 aa, Artificial Sequence
  Peptide Derived from Human Papillomavirus
GLYYVKEGYNTFYIE

SEQ ID NO: 50610 - protein, 15 aa, Artificial Sequence
  Peptide Derived from Human Papillomavirus
IIHLKGDRNSLKCLR

SEQ ID NO: 50611 - protein, 15 aa, Artificial Sequence
  Peptide Derived from Human Papillomavirus
MTYVAWDSVYYMTDA

SEQ ID NO: 50612 - protein, 15 aa, Artificial Sequence
  Peptide Derived from Human Papillomavirus
QSRYKTEDWTLQDTC

SEQ ID NO: 50613 - protein, 15 aa, Artificial Sequence
  Peptide Derived from Human Papillomavirus
SVYYMTDAGTWDKTA

SEQ ID NO: 50614 - protein, 15 aa, Artificial Sequence
  Peptide Derived from Human Papillomavirus
TVQVYFDGNKDNCMT

SEQ ID NO: 50615 - protein, 15 aa, Artificial Sequence
  Peptide Derived from Human Papillomavirus
TVTYHSETQRTKFLN

SEQ ID NO: 50616 - protein, 15 aa, Artificial Sequence
  Peptide Derived from Human Papillomavirus
WQLIRWENAIFFAAR

SEQ ID NO: 50617 - protein, 15 aa, Artificial Sequence
  Peptide Derived from Human Papillomavirus
YIEFKSECEKYGNTG

SEQ ID NO: 50618 - protein, 15 aa, Artificial Sequence
  Peptide Derived from Human Papillomavirus
LFVVYRDSIPHAACH

SEQ ID NO: 50619 - protein, 15 aa, Artificial Sequence
  Peptide Derived from Human Papillomavirus
LPDLCTELNTSLQDI

SEQ ID NO: 50620 - protein, 15 aa, Artificial Sequence
  Peptide Derived from Human Papillomavirus
SDSVYGDTLEKLTNT

SEQ ID NO: 50621 - protein, 15 aa, Artificial Sequence
  Peptide Derived from Human Papillomavirus
DIVLHLEPQNEIPVD

SEQ ID NO: 50622 - protein, 15 aa, Artificial Sequence
  Peptide Derived from Human Papillomavirus
QNEIPVDLLCHEQLS

SEQ ID NO: 50623 - protein, 15 aa, Artificial Sequence
  Peptide Derived from Human Papillomavirus
RIKLVVESSADDLRA

SEQ ID NO: 50624 - protein, 15 aa, Artificial Sequence
  Peptide Derived from Human Papillomavirus
VDLLCHEQLSDSEEE

SEQ ID NO: 50625 - protein, 15 aa, Artificial Sequence
  Peptide Derived from Human Papillomavirus
ARVVNTDDYVTPTSI

SEQ ID NO: 50626 - protein, 15 aa, Artificial Sequence
  Peptide Derived from Human Papillomavirus
FFCLRREQLFARHFW

SEQ ID NO: 50627 - protein, 15 aa, Artificial Sequence
  Peptide Derived from Human Papillomavirus
GSIVTSDSQLFNKPY

SEQ ID NO: 50628 - protein, 15 aa, Artificial Sequence
  Peptide Derived from Human Papillomavirus
KCEVPLDICQSICKY

SEQ ID NO: 50629 - protein, 15 aa, Artificial Sequence
  Peptide Derived from Human Papillomavirus
KEKFSLDLDQYPLGR

SEQ ID NO: 50630 - protein, 15 aa, Artificial Sequence
  Peptide Derived from Human Papillomavirus
KFSLDLDQYPLGRKF

SEQ ID NO: 50631 - protein, 15 aa, Artificial Sequence
  Peptide Derived from Human Papillomavirus
KNTVLEDGDMVDTGY

SEQ ID NO: 50632 - protein, 15 aa, Artificial Sequence
  Peptide Derived from Human Papillomavirus
NSSILEDWNFGVPPP

SEQ ID NO: 50633 - protein, 15 aa, Artificial Sequence
  Peptide Derived from Human Papillomavirus
TITLTADVMSYIHSM

SEQ ID NO: 50634 - protein, 15 aa, Artificial Sequence
  Peptide Derived from Human Papillomavirus
TSIYNPETQRLVWAC

SEQ ID NO: 50635 - protein, 15 aa, Artificial Sequence
  Peptide Derived from Human Papillomavirus
YLQMSADPYGDSMFF

SEQ ID NO: 50636 - protein, 15 aa, Artificial Sequence
  Peptide Derived from Human Papillomavirus
FDIYADDMDPAVPVP

SEQ ID NO: 50637 - protein, 15 aa, Artificial Sequence
  Peptide Derived from Human Papillomavirus
IVTLIEDSSVVTSGA

SEQ ID NO: 50638 - protein, 15 aa, Artificial Sequence
  Peptide Derived from Human Papillomavirus
LFDIYADDMDPAVPV

SEQ ID NO: 50639 - protein, 15 aa, Artificial Sequence
  Peptide Derived from Human Papillomavirus
RPPVVIEPVGPTDPS

SEQ ID NO: 50640 - protein, 15 aa, Artificial Sequence
  Peptide Derived from Human Papillomavirus
RVHFYHDISPIAPSP

SEQ ID NO: 50641 - protein, 15 aa, Artificial Sequence
  Peptide Derived from Human Papillomavirus
SSLITYDNPAFEPVD

SEQ ID NO: 50642 - protein, 12 aa, Artificial Sequence
  Peptide Derived from Human Papillomavirus
VPYFFADGFVAA

SEQ ID NO: 50643 - protein, 15 aa, Artificial Sequence
  Peptide Derived from Human Papillomavirus
CDKVSDEGDWRDIVK

SEQ ID NO: 50644 - protein, 15 aa, Artificial Sequence
  Peptide Derived from Human Papillomavirus
DNDVMDDSEIAYKYA

SEQ ID NO: 50645 - protein, 15 aa, Artificial Sequence
  Peptide Derived from Human Papillomavirus
GDNISEDENEDSSDT

SEQ ID NO: 50646 - protein, 15 aa, Artificial Sequence
  Peptide Derived from Human Papillomavirus
ISDVYGETPEWIERQ

SEQ ID NO: 50647 - protein, 15 aa, Artificial Sequence
  Peptide Derived from Human Papillomavirus
KIGMLDDATTPCWHY

SEQ ID NO: 50648 - protein, 15 aa, Artificial Sequence
  Peptide Derived from Human Papillomavirus
KNRITIEKLLEKLLC

SEQ ID NO: 50649 - protein, 15 aa, Artificial Sequence
  Peptide Derived from Human Papillomavirus
LKAICIENNSKTAKR

SEQ ID NO: 50650 - protein, 15 aa, Artificial Sequence
  Peptide Derived from Human Papillomavirus
NGWFYVEAVIDRQTG

SEQ ID NO: 50651 - protein, 15 aa, Artificial Sequence
  Peptide Derived from Human Papillomavirus
PNPFPFDKNGNPVYE

SEQ ID NO: 50652 - protein, 15 aa, Artificial Sequence
  Peptide Derived from Human Papillomavirus
QAKIVKDCGTMCRHY

SEQ ID NO: 50653 - protein, 15 aa, Artificial Sequence
  Peptide Derived from Human Papillomavirus
QQMVQVEEQQTTLSC

SEQ ID NO: 50654 - protein, 15 aa, Artificial Sequence
  Peptide Derived from Human Papillomavirus
QWAYDNDVMDDSEIA

SEQ ID NO: 50655 - protein, 15 aa, Artificial Sequence
  Peptide Derived from Human Papillomavirus
RLNLHEEEDKENDGD

SEQ ID NO: 50656 - protein, 15 aa, Artificial Sequence
  Peptide Derived from Human Papillomavirus
ELQMMLETLNNTEYK

SEQ ID NO: 50657 - protein, 15 aa, Artificial Sequence
  Peptide Derived from Human Papillomavirus
ESVFSSDEISFAGIV

SEQ ID NO: 50658 - protein, 15 aa, Artificial Sequence
  Peptide Derived from Human Papillomavirus
FIYLCIDGQCTVVEG

SEQ ID NO: 50659 - protein, 15 aa, Artificial Sequence
  Peptide Derived from Human Papillomavirus
IIHLKGDANILKCLR

SEQ ID NO: 50660 - protein, 15 aa, Artificial Sequence
  Peptide Derived from Human Papillomavirus
KHGYTVEVQFDGDVH

SEQ ID NO: 50661 - protein, 15 aa, Artificial Sequence
  Peptide Derived from Human Papillomavirus
NKLLRGDSVDSVNCG

SEQ ID NO: 50662 - protein, 15 aa, Artificial Sequence
  Peptide Derived from Human Papillomavirus
NTEYKNEDWTMQQTS

SEQ ID NO: 50663 - protein, 15 aa, Artificial Sequence
  Peptide Derived from Human Papillomavirus
QVIVFPESVFSSDEI

SEQ ID NO: 50664 - protein, 15 aa, Artificial Sequence
  Peptide Derived from Human Papillomavirus
RLNVCQDKILEHYEN

SEQ ID NO: 50665 - protein, 15 aa, Artificial Sequence
  Peptide Derived from Human Papillomavirus
TVEVQFDGDVHNTMH

SEQ ID NO: 50666 - protein, 15 aa, Artificial Sequence
  Peptide Derived from Human Papillomavirus
WKHIRLECVLMYKAR

SEQ ID NO: 50667 - protein, 15 aa, Artificial Sequence
  Peptide Derived from Human Papillomavirus
ALEIPYDELRLNCVY

SEQ ID NO: 50668 - protein, 15 aa, Artificial Sequence
  Peptide Derived from Human Papillomavirus
LTIVYRDDTPHGVCT

SEQ ID NO: 50669 - protein, 15 aa, Artificial Sequence
  Peptide Derived from Human Papillomavirus
TIVYRDDTPHGVCTK

SEQ ID NO: 50670 - protein, 12 aa, Artificial Sequence
  Peptide Derived from Human Papillomavirus
MRGETPTLQDYV

SEQ ID NO: 50671 - protein, 15 aa, Artificial Sequence
  Peptide Derived from Human Papillomavirus
DIRILQELLMGSFGI

SEQ ID NO: 50672 - protein, 15 aa, Artificial Sequence
  Peptide Derived from Human Papillomavirus
LQDYVLDLQPEATDL

SEQ ID NO: 50673 - protein, 15 aa, Artificial Sequence
  Peptide Derived from Human Papillomavirus
VLDLQPEATDLHCYE

SEQ ID NO: 50674 - protein, 15 aa, Artificial Sequence
  Peptide Derived from Human Papillomavirus
FFYLRREQMFVRHFF

SEQ ID NO: 50675 - protein, 15 aa, Artificial Sequence
  Peptide Derived from Human Papillomavirus
GESVPTDLYIKGSGS

SEQ ID NO: 50676 - protein, 15 aa, Artificial Sequence
  Peptide Derived from Human Papillomavirus
GSMVTSDAQIFNKPY

SEQ ID NO: 50677 - protein, 15 aa, Artificial Sequence
  Peptide Derived from Human Papillomavirus
KDYVFWEVNLKEKFS

SEQ ID NO: 50678 - protein, 15 aa, Artificial Sequence
  Peptide Derived from Human Papillomavirus
KEKFSADLDQFPLGR

SEQ ID NO: 50679 - protein, 15 aa, Artificial Sequence
  Peptide Derived from Human Papillomavirus
KITLSADIMTYIHSM

SEQ ID NO: 50680 - protein, 15 aa, Artificial Sequence
  Peptide Derived from Human Papillomavirus
KNSVIQDGDMVDTGF

SEQ ID NO: 50681 - protein, 15 aa, Artificial Sequence
  Peptide Derived from Human Papillomavirus
KSNVPLDICNSICKY

SEQ ID NO: 50682 - protein, 15 aa, Artificial Sequence
  Peptide Derived from Human Papillomavirus
NPAILEDWNFGLTTP

SEQ ID NO: 50683 - protein, 15 aa, Artificial Sequence
  Peptide Derived from Human Papillomavirus
SKVVSTDEYVTRTNI

SEQ ID NO: 50684 - protein, 15 aa, Artificial Sequence
  Peptide Derived from Human Papillomavirus
TSFYNPETQRLVWAC

SEQ ID NO: 50685 - protein, 15 aa, Artificial Sequence
  Peptide Derived from Human Papillomavirus
WACVGLEVGRGQPLG

SEQ ID NO: 50686 - protein, 15 aa, Artificial Sequence
  Peptide Derived from Human Papillomavirus
YLKMVAEPYGDTLFF

SEQ ID NO: 50687 - protein, 15 aa, Artificial Sequence
  Peptide Derived from Human Papillomavirus
DTDFTVDTPATHNVS

SEQ ID NO: 50688 - protein, 15 aa, Artificial Sequence
  Peptide Derived from Human Papillomavirus
GPDVPIEHAPTQVFP

SEQ ID NO: 50689 - protein, 15 aa, Artificial Sequence
  Peptide Derived from Human Papillomavirus
IVSLVEESGIVDVGA

SEQ ID NO: 50690 - protein, 15 aa, Artificial Sequence
  Peptide Derived from Human Papillomavirus
KQLITYENPAYETVN

SEQ ID NO: 50691 - protein, 15 aa, Artificial Sequence
  Peptide Derived from Human Papillomavirus
LYDIYADTDFTVDTP

SEQ ID NO: 50692 - protein, 15 aa, Artificial Sequence
  Peptide Derived from Human Papillomavirus
QVSIFVDGGDFYLHP

SEQ ID NO: 50693 - protein, 15 aa, Artificial Sequence
  Peptide Derived from Human Papillomavirus
RPPVSIDPVGPLDPS

SEQ ID NO: 50694 - protein, 15 aa, Artificial Sequence
  Peptide Derived from Human Papillomavirus
RVHYYYDISSINPAG

SEQ ID NO: 50695 - protein, 15 aa, Artificial Sequence
  Peptide Derived from Human Papillomavirus
SHNIAPDPDFLDIIA

SEQ ID NO: 50696 - protein, 12 aa, Artificial Sequence
  Peptide Derived from Human Papillomavirus
VSYFFTDVSVAA

SEQ ID NO: 50697 - protein, 15 aa, Artificial Sequence
  Peptide Derived from Human Papillomavirus
YEEIPMDTFIVSTNN

SEQ ID NO: 50698 - protein, 15 aa, Artificial Sequence
  Peptide Derived from Human Papillomavirus
YETVNAEESLYFSNT

SEQ ID NO: 50699 - protein, 15 aa, Artificial Sequence
  Peptide Derived from Human Papillomavirus
DNELTDDSDIAYYYA

SEQ ID NO: 50700 - protein, 15 aa, Artificial Sequence
  Peptide Derived from Human Papillomavirus
DSEVSCETNVDSCEN

SEQ ID NO: 50701 - protein, 15 aa, Artificial Sequence
  Peptide Derived from Human Papillomavirus
ENSIQADTEAARALF

SEQ ID NO: 50702 - protein, 15 aa, Artificial Sequence
  Peptide Derived from Human Papillomavirus
ETCMVIEPPKLRSQT

SEQ ID NO: 50703 - protein, 15 aa, Artificial Sequence
  Peptide Derived from Human Papillomavirus
GDNISEDEDETADDS

SEQ ID NO: 50704 - protein, 15 aa, Artificial Sequence
  Peptide Derived from Human Papillomavirus
KIGMIDDVTPISWTY

SEQ ID NO: 50705 - protein, 15 aa, Artificial Sequence
  Peptide Derived from Human Papillomavirus
KLDLIEEEDKENHGG

SEQ ID NO: 50706 - protein, 15 aa, Artificial Sequence
  Peptide Derived from Human Papillomavirus
KNPFPFDENGNPVYA

SEQ ID NO: 50707 - protein, 15 aa, Artificial Sequence
  Peptide Derived from Human Papillomavirus
LLEFIDDSMENSIQA

SEQ ID NO: 50708 - protein, 15 aa, Artificial Sequence
  Peptide Derived from Human Papillomavirus
LQCLTCDRGIIILLL

SEQ ID NO: 50709 - protein, 15 aa, Artificial Sequence
  Peptide Derived from Human Papillomavirus
QAKIVKDCGIMCRHY

SEQ ID NO: 50710 - protein, 15 aa, Artificial Sequence
  Peptide Derived from Human Papillomavirus
QWAYDNELTDDSDIA

SEQ ID NO: 50711 - protein, 15 aa, Artificial Sequence
  Peptide Derived from Human Papillomavirus
SSGVGDDSEVSCETN

SEQ ID NO: 50712 - protein, 15 aa, Artificial Sequence
  Peptide Derived from Human Papillomavirus
SWTYIDDYMRNALDG

SEQ ID NO: 50713 - protein, 15 aa, Artificial Sequence
  Peptide Derived from Human Papillomavirus
TGWFEVEAVIERRTG

SEQ ID NO: 50714 - protein, 15 aa, Artificial Sequence
  Peptide Derived from Human Papillomavirus
VRPFKSDKTSCTDWC

SEQ ID NO: 50715 - protein, 15 aa, Artificial Sequence
  Peptide Derived from Human Papillomavirus
VYAINDENWKSFFSR

SEQ ID NO: 50716 - protein, 15 aa, Artificial Sequence
  Peptide Derived from Human Papillomavirus
EIYIIEEDTCTMVTG

SEQ ID NO: 50717 - protein, 15 aa, Artificial Sequence
  Peptide Derived from Human Papillomavirus
ELQMALETLSKSQYS

SEQ ID NO: 50718 - protein, 15 aa, Artificial Sequence
  Peptide Derived from Human Papillomavirus
FKYFKEDAAKYSKTQ

SEQ ID NO: 50719 - protein, 15 aa, Artificial Sequence
  Peptide Derived from Human Papillomavirus
GEIYIIEEDTCTMVT

SEQ ID NO: 50720 - protein, 15 aa, Artificial Sequence
  Peptide Derived from Human Papillomavirus
IVHLKGESNSLKCLR

SEQ ID NO: 50721 - protein, 15 aa, Artificial Sequence
  Peptide Derived from Human Papillomavirus
IYIIEEDTCTMVTGK

SEQ ID NO: 50722 - protein, 15 aa, Artificial Sequence
  Peptide Derived from Human Papillomavirus
LDLYEADKTDLPSQI

SEQ ID NO: 50723 - protein, 15 aa, Artificial Sequence
  Peptide Derived from Human Papillomavirus
TADIQTDNDNRPPQA

SEQ ID NO: 50724 - protein, 15 aa, Artificial Sequence
  Peptide Derived from Human Papillomavirus
TKLFCADPALDNRTA

SEQ ID NO: 50725 - protein, 15 aa, Artificial Sequence
  Peptide Derived from Human Papillomavirus
TVTFVTEQQQQMFLG

SEQ ID NO: 50726 - protein, 15 aa, Artificial Sequence
  Peptide Derived from Human Papillomavirus
TVTVQYDNDKKNTMD

SEQ ID NO: 50727 - protein, 15 aa, Artificial Sequence
  Peptide Derived from Human Papillomavirus
WKLIRMECALLYTAK

SEQ ID NO: 50728 - protein, 15 aa, Artificial Sequence
  Peptide Derived from Human Papillomavirus
YFKYFKEDAAKYSKT

SEQ ID NO: 50729 - protein, 12 aa, Artificial Sequence
  Peptide Derived from Human Papillomavirus
MFQDTEEKPRTL

SEQ ID NO: 50730 - protein, 15 aa, Artificial Sequence
  Peptide Derived from Human Papillomavirus
LTVVYREGNPFGICK

SEQ ID NO: 50731 - protein, 15 aa, Artificial Sequence
  Peptide Derived from Human Papillomavirus
LKEYVLDLYPEPTDL

SEQ ID NO: 50732 - protein, 15 aa, Artificial Sequence
  Peptide Derived from Human Papillomavirus
TDLYCYEQLSDSSDE

SEQ ID NO: 50733 - protein, 15 aa, Artificial Sequence
  Peptide Derived from Human Papillomavirus
VLDLYPEPTDLYCYE

SEQ ID NO: 50734 - protein, 15 aa, Artificial Sequence
  Peptide Derived from Human Papillomavirus
CTQVTSDSTYKNENF

SEQ ID NO: 50735 - protein, 15 aa, Artificial Sequence
  Peptide Derived from Human Papillomavirus
DSTYKNENFKEYIRH

SEQ ID NO: 50736 - protein, 15 aa, Artificial Sequence
  Peptide Derived from Human Papillomavirus
FFFLRREQMFVRHFF

SEQ ID NO: 50737 - protein, 15 aa, Artificial Sequence
  Peptide Derived from Human Papillomavirus
GEAVPDDLYIKGSGT

SEQ ID NO: 50738 - protein, 15 aa, Artificial Sequence
  Peptide Derived from Human Papillomavirus
GSMVTSESQLFNKPY

SEQ ID NO: 50739 - protein, 15 aa, Artificial Sequence
  Peptide Derived from Human Papillomavirus
IHAMNPDILEDWQFG

SEQ ID NO: 50740 - protein, 15 aa, Artificial Sequence
  Peptide Derived from Human Papillomavirus
INTIIEDGDMVDTGF

SEQ ID NO: 50741 - protein, 15 aa, Artificial Sequence
  Peptide Derived from Human Papillomavirus
KEKFSADLDQFPLGR

SEQ ID NO: 50742 - protein, 15 aa, Artificial Sequence
  Peptide Derived from Human Papillomavirus
KSDVPIDICGSTCKY

SEQ ID NO: 50743 - protein, 15 aa, Artificial Sequence
  Peptide Derived from Human Papillomavirus
KVTLTAEVMTYIHAM

SEQ ID NO: 50744 - protein, 15 aa, Artificial Sequence
  Peptide Derived from Human Papillomavirus
NPDILEDWQFGLTPP

SEQ ID NO: 50745 - protein, 15 aa, Artificial Sequence
  Peptide Derived from Human Papillomavirus
SKVVSTDEYVSRTSI

SEQ ID NO: 50746 - protein, 15 aa, Artificial Sequence
  Peptide Derived from Human Papillomavirus
TSFYNPDTQRLVWAC

SEQ ID NO: 50747 - protein, 15 aa, Artificial Sequence
  Peptide Derived from Human Papillomavirus
WACVGLEIGRGQPLG

SEQ ID NO: 50748 - protein, 15 aa, Artificial Sequence
  Peptide Derived from Human Papillomavirus
YLKMTSEPYGDSLFF

SEQ ID NO: 50749 - protein, 15 aa, Artificial Sequence
  Peptide Derived from Human Papillomavirus
DHTVPNEQYELQPLH

SEQ ID NO: 50750 - protein, 15 aa, Artificial Sequence
  Peptide Derived from Human Papillomavirus
FDTIVVDGADFVLHP

SEQ ID NO: 50751 - protein, 15 aa, Artificial Sequence
  Peptide Derived from Human Papillomavirus
FESFDPEDTLQFQHS

SEQ ID NO: 50752 - protein, 15 aa, Artificial Sequence
  Peptide Derived from Human Papillomavirus
HKLITYDNPAFESFD

SEQ ID NO: 50753 - protein, 15 aa, Artificial Sequence
  Peptide Derived from Human Papillomavirus
IVSLIEETSFIEAGA

SEQ ID NO: 50754 - protein, 15 aa, Artificial Sequence
  Peptide Derived from Human Papillomavirus
LYDVYADDVDNVHTP

SEQ ID NO: 50755 - protein, 15 aa, Artificial Sequence
  Peptide Derived from Human Papillomavirus
RIHYYQDLSPIVPLD

SEQ ID NO: 50756 - protein, 15 aa, Artificial Sequence
  Peptide Derived from Human Papillomavirus
RPPVTVDTVGPLDSS

SEQ ID NO: 50757 - protein, 15 aa, Artificial Sequence
  Peptide Derived from Human Papillomavirus
SPFFPFDTIVVDGAD

SEQ ID NO: 50758 - protein, 15 aa, Artificial Sequence
  Peptide Derived from Human Papillomavirus
SPIVPLDHTVPNEQY

SEQ ID NO: 50759 - protein, 15 aa, Artificial Sequence
  Peptide Derived from Human Papillomavirus
TFVVSTDSSNVTSST

SEQ ID NO: 50760 - protein, 15 aa, Artificial Sequence
  Peptide Derived from Human Papillomavirus
YDVYADDVDNVHTPM

SEQ ID NO: 50761 - protein, 15 aa, Artificial Sequence
  Peptide Derived from Human Papillomavirus
YENIPMDTFVVSTDS

SEQ ID NO: 50762 - protein, 15 aa, Artificial Sequence
  Peptide Derived from Human Papillomavirus
YVPIGTDPPTAAIPL

SEQ ID NO: 50763 - protein, 15 aa, Artificial Sequence
  Peptide Derived from Human Papillomavirus
AQEVQNDAQVLHLLK

SEQ ID NO: 50764 - protein, 15 aa, Artificial Sequence
  Peptide Derived from Human Papillomavirus
DNDLTDESDMAFQYA

SEQ ID NO: 50765 - protein, 15 aa, Artificial Sequence
  Peptide Derived from Human Papillomavirus
ETCMLIEPPKLRSSV

SEQ ID NO: 50766 - protein, 15 aa, Artificial Sequence
  Peptide Derived from Human Papillomavirus
GDVISDDEDETATDT

SEQ ID NO: 50767 - protein, 15 aa, Artificial Sequence
  Peptide Derived from Human Papillomavirus
GEQLSVDTDLSPRLQ

SEQ ID NO: 50768 - protein, 15 aa, Artificial Sequence
  Peptide Derived from Human Papillomavirus
ISEVSGDTPEWIQRL

SEQ ID NO: 50769 - protein, 15 aa, Artificial Sequence
  Peptide Derived from Human Papillomavirus
KVAMLDDATHTCWTY

SEQ ID NO: 50770 - protein, 15 aa, Artificial Sequence
  Peptide Derived from Human Papillomavirus
MLAVFKDIYGLSFTD

SEQ ID NO: 50771 - protein, 15 aa, Artificial Sequence
  Peptide Derived from Human Papillomavirus
NGWFFVETIVEKKTG

SEQ ID NO: 50772 - protein, 15 aa, Artificial Sequence
  Peptide Derived from Human Papillomavirus
NSHFWLEPLADTKVA

SEQ ID NO: 50773 - protein, 15 aa, Artificial Sequence
  Peptide Derived from Human Papillomavirus
PHAFPFDKNGNPVYE

SEQ ID NO: 50774 - protein, 15 aa, Artificial Sequence
  Peptide Derived from Human Papillomavirus
QAKYLKDCAVMCRHY

SEQ ID NO: 50775 - protein, 15 aa, Artificial Sequence
  Peptide Derived from Human Papillomavirus
QLSVDTDLSPRLQEI

SEQ ID NO: 50776 - protein, 15 aa, Artificial Sequence
  Peptide Derived from Human Papillomavirus
QWAFDNDLTDESDMA

SEQ ID NO: 50777 - protein, 15 aa, Artificial Sequence
  Peptide Derived from Human Papillomavirus
RLDLHEDDEDADTEG

SEQ ID NO: 50778 - protein, 15 aa, Artificial Sequence
  Peptide Derived from Human Papillomavirus
TGDVISDDEDETATD

SEQ ID NO: 50779 - protein, 15 aa, Artificial Sequence
  Peptide Derived from Human Papillomavirus
VRNFKSDKTTCTDWV

SEQ ID NO: 50780 - protein, 15 aa, Artificial Sequence
  Peptide Derived from Human Papillomavirus
GVYYIKDGDTTYYVQ

SEQ ID NO: 50781 - protein, 15 aa, Artificial Sequence
  Peptide Derived from Human Papillomavirus
IIHLKGDKNSLKCLR

SEQ ID NO: 50782 - protein, 15 aa, Artificial Sequence
  Peptide Derived from Human Papillomavirus
MNYVVWDSIYYITET

SEQ ID NO: 50783 - protein, 15 aa, Artificial Sequence
  Peptide Derived from Human Papillomavirus
QSKYNNEEWTLQDTC

SEQ ID NO: 50784 - protein, 15 aa, Artificial Sequence
  Peptide Derived from Human Papillomavirus
SIYYITETGIWDKTA

SEQ ID NO: 50785 - protein, 15 aa, Artificial Sequence
  Peptide Derived from Human Papillomavirus
TVHVYFDGNKDNCMN

SEQ ID NO: 50786 - protein, 15 aa, Artificial Sequence
  Peptide Derived from Human Papillomavirus
TVTYNSEVQRNTFLD

SEQ ID NO: 50787 - protein, 15 aa, Artificial Sequence
  Peptide Derived from Human Papillomavirus
WQLIRLENAILFTAR

SEQ ID NO: 50788 - protein, 15 aa, Artificial Sequence
  Peptide Derived from Human Papillomavirus
YVQFKSECEKYGNSN

SEQ ID NO: 50789 - protein, 15 aa, Artificial Sequence
  Peptide Derived from Human Papillomavirus
LFIVYRDCIAYAACH

SEQ ID NO: 50790 - protein, 15 aa, Artificial Sequence
  Peptide Derived from Human Papillomavirus
LPDLCTELNTSLQDV

SEQ ID NO: 50791 - protein, 15 aa, Artificial Sequence
  Peptide Derived from Human Papillomavirus
SNSVYGETLEKITNT

SEQ ID NO: 50792 - protein, 15 aa, Artificial Sequence
  Peptide Derived from Human Papillomavirus
EIVLHLEPQNELDPV

SEQ ID NO: 50793 - protein, 15 aa, Artificial Sequence
  Peptide Derived from Human Papillomavirus
RIELTVESSADDLRT

SEQ ID NO: 50794 - protein, 15 aa, Artificial Sequence
  Peptide Derived from Human Papillomavirus
VDLLCYEQLSESEEE

SEQ ID NO: 50795 - protein, 15 aa, Artificial Sequence
  Peptide Derived from Human Papillomavirus
ARVVNTDDYVSRTSI

SEQ ID NO: 50796 - protein, 15 aa, Artificial Sequence
  Peptide Derived from Human Papillomavirus
FFCLRREQLFARHFW

SEQ ID NO: 50797 - protein, 15 aa, Artificial Sequence
  Peptide Derived from Human Papillomavirus
GDTVPTDLYIKGTSA

SEQ ID NO: 50798 - protein, 15 aa, Artificial Sequence
  Peptide Derived from Human Papillomavirus
KCEVPLDICQSICKY

SEQ ID NO: 50799 - protein, 15 aa, Artificial Sequence
  Peptide Derived from Human Papillomavirus
KEKFSSDLDQYPLGR

SEQ ID NO: 50800 - protein, 15 aa, Artificial Sequence
  Peptide Derived from Human Papillomavirus
KNTIIEDGDMVDTGY

SEQ ID NO: 50801 - protein, 15 aa, Artificial Sequence
  Peptide Derived from Human Papillomavirus
RAGVMGDTVPTDLYI

SEQ ID NO: 50802 - protein, 15 aa, Artificial Sequence
  Peptide Derived from Human Papillomavirus
STIYNPETQRLVWAC

SEQ ID NO: 50803 - protein, 15 aa, Artificial Sequence
  Peptide Derived from Human Papillomavirus
TITLTAEVMSYIHSM

SEQ ID NO: 50804 - protein, 15 aa, Artificial Sequence
  Peptide Derived from Human Papillomavirus
WACVGMEIGRGQPLG

SEQ ID NO: 50805 - protein, 15 aa, Artificial Sequence
  Peptide Derived from Human Papillomavirus
YLQMSADPYGDSMFF

SEQ ID NO: 50806 - protein, 15 aa, Artificial Sequence
  Peptide Derived from Human Papillomavirus
DTTLSFEPTSNVPDS

SEQ ID NO: 50807 - protein, 12 aa, Artificial Sequence
  Peptide Derived from Human Papillomavirus
IPYFFADGFVAA

SEQ ID NO: 50808 - protein, 15 aa, Artificial Sequence
  Peptide Derived from Human Papillomavirus
IVTLVEDSSVVASGA

SEQ ID NO: 50809 - protein, 15 aa, Artificial Sequence
  Peptide Derived from Human Papillomavirus
LFDVYADFPPPASTT

SEQ ID NO: 50810 - protein, 15 aa, Artificial Sequence
  Peptide Derived from Human Papillomavirus
RPPVVIEPVGPTDPS

SEQ ID NO: 50811 - protein, 15 aa, Artificial Sequence
  Peptide Derived from Human Papillomavirus
RVHFYHDISPIAATE

SEQ ID NO: 50812 - protein, 15 aa, Artificial Sequence
  Peptide Derived from Human Papillomavirus
SSLVTFDNPAYEPLD

SEQ ID NO: 50813 - protein, 15 aa, Artificial Sequence
  Peptide Derived from Human Papillomavirus
ESIYCPDSVSSTCRY

SEQ ID NO: 50814 - protein, 15 aa, Artificial Sequence
  Peptide Derived from Human Papillomavirus
EVHMENESIYCPDSV

SEQ ID NO: 50815 - protein, 15 aa, Artificial Sequence
  Peptide Derived from Human Papillomavirus
EVQIALESLSTTIYN

SEQ ID NO: 50816 - protein, 15 aa, Artificial Sequence
  Peptide Derived from Human Papillomavirus
HIEVWFDGSKNNCMQ

SEQ ID NO: 50817 - protein, 15 aa, Artificial Sequence
  Peptide Derived from Human Papillomavirus
HKTYYTDFEQEAKKF

SEQ ID NO: 50818 - protein, 15 aa, Artificial Sequence
  Peptide Derived from Human Papillomavirus
ITIIYKDETQRNSFL

SEQ ID NO: 50819 - protein, 15 aa, Artificial Sequence
  Peptide Derived from Human Papillomavirus
IWEVHMENESIYCPD

SEQ ID NO: 50820 - protein, 15 aa, Artificial Sequence
  Peptide Derived from Human Papillomavirus
KKCFKKEGQHIEVWF

SEQ ID NO: 50821 - protein, 15 aa, Artificial Sequence
  Peptide Derived from Human Papillomavirus
TIIYKDETQRNSFLS

SEQ ID NO: 50822 - protein, 15 aa, Artificial Sequence
  Peptide Derived from Human Papillomavirus
TTIYNNEEWTLRDTC

SEQ ID NO: 50823 - protein, 15 aa, Artificial Sequence
  Peptide Derived from Human Papillomavirus
VVHLKGEPNRLKCCR

SEQ ID NO: 50824 - protein, 15 aa, Artificial Sequence
  Peptide Derived from Human Papillomavirus
YIYYNGDCGWQKVCS

SEQ ID NO: 50825 - protein, 15 aa, Artificial Sequence
  Peptide Derived from Human Papillomavirus
YKTLFVDVTSTYHWT

SEQ ID NO: 50826 - protein, 15 aa, Artificial Sequence
  Peptide Derived from Human Papillomavirus
KLVYRDDFPYAVCRV

SEQ ID NO: 50827 - protein, 15 aa, Artificial Sequence
  Peptide Derived from Human Papillomavirus
LKLVYRDDFPYAVCR

SEQ ID NO: 50828 - protein, 15 aa, Artificial Sequence
  Peptide Derived from Human Papillomavirus
KFVVQLDIQSTKEDL

SEQ ID NO: 50829 - protein, 15 aa, Artificial Sequence
  Peptide Derived from Human Papillomavirus
LQDVVLELTPQTEID

SEQ ID NO: 50830 - protein, 15 aa, Artificial Sequence
  Peptide Derived from Human Papillomavirus
GETIPAELYLKGSNG

SEQ ID NO: 50831 - protein, 15 aa, Artificial Sequence
  Peptide Derived from Human Papillomavirus
GLCIFLDVGAVNVFP

SEQ ID NO: 50832 - protein, 15 aa, Artificial Sequence
  Peptide Derived from Human Papillomavirus
GSMITSEAQLFNKPY

SEQ ID NO: 50833 - protein, 15 aa, Artificial Sequence
  Peptide Derived from Human Papillomavirus
KAEVPLDIVQSTCKY

SEQ ID NO: 50834 - protein, 15 aa, Artificial Sequence
  Peptide Derived from Human Papillomavirus
KITLSAEVMAYLHNM

SEQ ID NO: 50835 - protein, 15 aa, Artificial Sequence
  Peptide Derived from Human Papillomavirus
MMYIYRDPPLHYGLC

SEQ ID NO: 50836 - protein, 15 aa, Artificial Sequence
  Peptide Derived from Human Papillomavirus
NANLLEDWNIGLSPP

SEQ ID NO: 50837 - protein, 15 aa, Artificial Sequence
  Peptide Derived from Human Papillomavirus
QDSFSTDLDQFPLGR

SEQ ID NO: 50838 - protein, 15 aa, Artificial Sequence
  Peptide Derived from Human Papillomavirus
SKVVATDSYVKRTSI

SEQ ID NO: 50839 - protein, 15 aa, Artificial Sequence
  Peptide Derived from Human Papillomavirus
TNIYNPDQERLVWAC

SEQ ID NO: 50840 - protein, 15 aa, Artificial Sequence
  Peptide Derived from Human Papillomavirus
WACVGLEVGRGQPLG

SEQ ID NO: 50841 - protein, 15 aa, Artificial Sequence
  Peptide Derived from Human Papillomavirus
WFYLRREQLFARHYF

SEQ ID NO: 50842 - protein, 15 aa, Artificial Sequence
  Peptide Derived from Human Papillomavirus
YLKMSADAYGDSMWF

SEQ ID NO: 50843 - protein, 15 aa, Artificial Sequence
  Peptide Derived from Human Papillomavirus
YYSVTKDNTKTNIPK

SEQ ID NO: 50844 - protein, 15 aa, Artificial Sequence
  Peptide Derived from Human Papillomavirus
ATLVSADNPLFEGTD

SEQ ID NO: 50845 - protein, 12 aa, Artificial Sequence
  Peptide Derived from Human Papillomavirus
IPYFFADGDVAA

SEQ ID NO: 50846 - protein, 15 aa, Artificial Sequence
  Peptide Derived from Human Papillomavirus
IVTLVEESSVIESGA

SEQ ID NO: 50847 - protein, 15 aa, Artificial Sequence
  Peptide Derived from Human Papillomavirus
PSGVAPDPDFMNIVA

SEQ ID NO: 50848 - protein, 15 aa, Artificial Sequence
  Peptide Derived from Human Papillomavirus
PYDVTHDVYIQGSSF

SEQ ID NO: 50849 - protein, 15 aa, Artificial Sequence
  Peptide Derived from Human Papillomavirus
RPPIVVESVGPTDPS

SEQ ID NO: 50850 - protein, 15 aa, Artificial Sequence
  Peptide Derived from Human Papillomavirus
RVHYYYDISPIAQAE

SEQ ID NO: 50851 - protein, 15 aa, Artificial Sequence
  Peptide Derived from Human Papillomavirus
TNPLFIDPPVIEAPQ

SEQ ID NO: 50852 - protein, 15 aa, Artificial Sequence
  Peptide Derived from Human Papillomavirus
YANIDDEAPGLSSQS

SEQ ID NO: 50853 - protein, 9 aa, Artificial Sequence
  Peptide Derived from Human Papillomavirus
YIDDNLRNA

SEQ ID NO: 50854 - protein, 9 aa, Artificial Sequence
  Peptide Derived from Human Papillomavirus
IVDDSEIAY

SEQ ID NO: 50855 - protein, 9 aa, Artificial Sequence
  Peptide Derived from Human Papillomavirus
ISDDENEND

SEQ ID NO: 50856 - protein, 9 aa, Artificial Sequence
  Peptide Derived from Human Papillomavirus
VYGDTPEWI

SEQ ID NO: 50857 - protein, 9 aa, Artificial Sequence
  Peptide Derived from Human Papillomavirus
MLDDATVPC

SEQ ID NO: 50858 - protein, 9 aa, Artificial Sequence
  Peptide Derived from Human Papillomavirus
ICIEKQSRA

SEQ ID NO: 50859 - protein, 9 aa, Artificial Sequence
  Peptide Derived from Human Papillomavirus
FYVEAVVEK

SEQ ID NO: 50860 - protein, 9 aa, Artificial Sequence
  Peptide Derived from Human Papillomavirus
MMIEPPKLR

SEQ ID NO: 50861 - protein, 9 aa, Artificial Sequence
  Peptide Derived from Human Papillomavirus
FPFDENGNP

SEQ ID NO: 50862 - protein, 9 aa, Artificial Sequence
  Peptide Derived from Human Papillomavirus
IVKDCATMC

SEQ ID NO: 50863 - protein, 9 aa, Artificial Sequence
  Peptide Derived from Human Papillomavirus
YDNDIVDDS

SEQ ID NO: 50864 - protein, 9 aa, Artificial Sequence
  Peptide Derived from Human Papillomavirus
LHEDEDKEN

SEQ ID NO: 50865 - protein, 9 aa, Artificial Sequence
  Peptide Derived from Human Papillomavirus
FESEDSGYG

SEQ ID NO: 50866 - protein, 9 aa, Artificial Sequence
  Peptide Derived from Human Papillomavirus
IVNDNDYLT

SEQ ID NO: 50867 - protein, 9 aa, Artificial Sequence
  Peptide Derived from Human Papillomavirus
FPNEFPFDE

SEQ ID NO: 50868 - protein, 9 aa, Artificial Sequence
  Peptide Derived from Human Papillomavirus
YRCDRVDDG

SEQ ID NO: 50869 - protein, 9 aa, Artificial Sequence
  Peptide Derived from Human Papillomavirus
LGTEETQTT

SEQ ID NO: 50870 - protein, 9 aa, Artificial Sequence
  Peptide Derived from Human Papillomavirus
LTLETIYNS

SEQ ID NO: 50871 - protein, 9 aa, Artificial Sequence
  Peptide Derived from Human Papillomavirus
FDGDICNTM

SEQ ID NO: 50872 - protein, 9 aa, Artificial Sequence
  Peptide Derived from Human Papillomavirus
FKDDAEKYS

SEQ ID NO: 50873 - protein, 9 aa, Artificial Sequence
  Peptide Derived from Human Papillomavirus
YVHEGIRTY

SEQ ID NO: 50874 - protein, 9 aa, Artificial Sequence
  Peptide Derived from Human Papillomavirus
ICEEASVTV

SEQ ID NO: 50875 - protein, 9 aa, Artificial Sequence
  Peptide Derived from Human Papillomavirus
LKGDANTLK

SEQ ID NO: 50876 - protein, 9 aa, Artificial Sequence
  Peptide Derived from Human Papillomavirus
LTYDSEWQR

SEQ ID NO: 50877 - protein, 9 aa, Artificial Sequence
  Peptide Derived from Human Papillomavirus
YTVEVQFDG

SEQ ID NO: 50878 - protein, 9 aa, Artificial Sequence
  Peptide Derived from Human Papillomavirus
VSLEVYLTA

SEQ ID NO: 50879 - protein, 9 aa, Artificial Sequence
  Peptide Derived from Human Papillomavirus
YENDSTDLR

SEQ ID NO: 50880 - protein, 9 aa, Artificial Sequence
  Peptide Derived from Human Papillomavirus
YSNEKWTLQ

SEQ ID NO: 50881 - protein, 9 aa, Artificial Sequence
  Peptide Derived from Human Papillomavirus
VCQDKILTH

SEQ ID NO: 50882 - protein, 9 aa, Artificial Sequence
  Peptide Derived from Human Papillomavirus
YICEEASVT

SEQ ID NO: 50883 - protein, 9 aa, Artificial Sequence
  Peptide Derived from Human Papillomavirus
LHRDSVDSA

SEQ ID NO: 50884 - protein, 9 aa, Artificial Sequence
  Peptide Derived from Human Papillomavirus
YDSEWQRDQ

SEQ ID NO: 50885 - protein, 9 aa, Artificial Sequence
  Peptide Derived from Human Papillomavirus
VQFDGDICN

SEQ ID NO: 50886 - protein, 9 aa, Artificial Sequence
  Peptide Derived from Human Papillomavirus
MRLECAIYY

SEQ ID NO: 50887 - protein, 9 aa, Artificial Sequence
  Peptide Derived from Human Papillomavirus
IILECVYCK

SEQ ID NO: 50888 - protein, 9 aa, Artificial Sequence
  Peptide Derived from Human Papillomavirus
VYRDGNPYA

SEQ ID NO: 50889 - protein, 9 aa, Artificial Sequence
  Peptide Derived from Human Papillomavirus
LCTELQTTI

SEQ ID NO: 50890 - protein, 9 aa, Artificial Sequence
  Peptide Derived from Human Papillomavirus
LRREVYDFA

SEQ ID NO: 50891 - protein, 9 aa, Artificial Sequence
  Peptide Derived from Human Papillomavirus
MFQDPQERP

SEQ ID NO: 50892 - protein, 9 aa, Artificial Sequence
  Peptide Derived from Human Papillomavirus
MHGDTPTLH

SEQ ID NO: 50893 - protein, 9 aa, Artificial Sequence
  Peptide Derived from Human Papillomavirus
YMLDLQPET

SEQ ID NO: 50894 - protein, 9 aa, Artificial Sequence
  Peptide Derived from Human Papillomavirus
LQPETTDLY

SEQ ID NO: 50895 - protein, 9 aa, Artificial Sequence
  Peptide Derived from Human Papillomavirus
YCYEQLNDS

SEQ ID NO: 50896 - protein, 9 aa, Artificial Sequence
  Peptide Derived from Human Papillomavirus
LRREQMFVR

SEQ ID NO: 50897 - protein, 9 aa, Artificial Sequence
  Peptide Derived from Human Papillomavirus
VPDDLYIKG

SEQ ID NO: 50898 - protein, 9 aa, Artificial Sequence
  Peptide Derived from Human Papillomavirus
VTSDAQIFN

SEQ ID NO: 50899 - protein, 9 aa, Artificial Sequence
  Peptide Derived from Human Papillomavirus
VIQDGDMVD

SEQ ID NO: 50900 - protein, 9 aa, Artificial Sequence
  Peptide Derived from Human Papillomavirus
YENDVNVYH

SEQ ID NO: 50901 - protein, 9 aa, Artificial Sequence
  Peptide Derived from Human Papillomavirus
FSADLDQFP

SEQ ID NO: 50902 - protein, 9 aa, Artificial Sequence
  Peptide Derived from Human Papillomavirus
LTADVMTYI

SEQ ID NO: 50903 - protein, 9 aa, Artificial Sequence
  Peptide Derived from Human Papillomavirus
VPLDICTSI

SEQ ID NO: 50904 - protein, 9 aa, Artificial Sequence
  Peptide Derived from Human Papillomavirus
ILEDWNFGL

SEQ ID NO: 50905 - protein, 9 aa, Artificial Sequence
  Peptide Derived from Human Papillomavirus
VSTDEYVAR

SEQ ID NO: 50906 - protein, 9 aa, Artificial Sequence
  Peptide Derived from Human Papillomavirus
LPSEATVYL

SEQ ID NO: 50907 - protein, 9 aa, Artificial Sequence
  Peptide Derived from Human Papillomavirus
YNPDTQRLV

SEQ ID NO: 50908 - protein, 9 aa, Artificial Sequence
  Peptide Derived from Human Papillomavirus
VGVEVGRGQ

SEQ ID NO: 50909 - protein, 9 aa, Artificial Sequence
  Peptide Derived from Human Papillomavirus
MVSEPYGDS

SEQ ID NO: 50910 - protein, 9 aa, Artificial Sequence
  Peptide Derived from Human Papillomavirus
FITDTSTTP

SEQ ID NO: 50911 - protein, 9 aa, Artificial Sequence
  Peptide Derived from Human Papillomavirus
LVEETSFID

SEQ ID NO: 50912 - protein, 9 aa, Artificial Sequence
  Peptide Derived from Human Papillomavirus
YYYDFSTID

SEQ ID NO: 50913 - protein, 9 aa, Artificial Sequence
  Peptide Derived from Human Papillomavirus
FFSDVSLAA

SEQ ID NO: 50914 - protein, 9 aa, Artificial Sequence
  Peptide Derived from Human Papillomavirus
IYADDFITD

SEQ ID NO: 50915 - protein, 9 aa, Artificial Sequence
  Peptide Derived from Human Papillomavirus
IIADAGDFY

SEQ ID NO: 50916 - protein, 9 aa, Artificial Sequence
  Peptide Derived from Human Papillomavirus
LTVDPVGPS

SEQ ID NO: 50917 - protein, 9 aa, Artificial Sequence
  Peptide Derived from Human Papillomavirus
IAPDPDFLD

SEQ ID NO: 50918 - protein, 9 aa, Artificial Sequence
  Peptide Derived from Human Papillomavirus
ITYDNPAYE

SEQ ID NO: 50919 - protein, 9 aa, Artificial Sequence
  Peptide Derived from Human Papillomavirus
IPPDVSGFS

SEQ ID NO: 50920 - protein, 9 aa, Artificial Sequence
  Peptide Derived from Human Papillomavirus
YADDFITDT

SEQ ID NO: 50921 - protein, 9 aa, Artificial Sequence
  Peptide Derived from Human Papillomavirus
IPMDTFIVS

SEQ ID NO: 50922 - protein, 9 aa, Artificial Sequence
  Peptide Derived from Human Papillomavirus
IDVDNTLYF

SEQ ID NO: 50923 - protein, 9 aa, Artificial Sequence
  Peptide Derived from Human Papillomavirus
VHNDAQVLH

SEQ ID NO: 50924 - protein, 9 aa, Artificial Sequence
  Peptide Derived from Human Papillomavirus
LTDESDMAF

SEQ ID NO: 50925 - protein, 9 aa, Artificial Sequence
  Peptide Derived from Human Papillomavirus
MAFEYALLA

SEQ ID NO: 50926 - protein, 9 aa, Artificial Sequence
  Peptide Derived from Human Papillomavirus
LLADSNSNA

SEQ ID NO: 50927 - protein, 9 aa, Artificial Sequence
  Peptide Derived from Human Papillomavirus
ISDDEDENA

SEQ ID NO: 50928 - protein, 9 aa, Artificial Sequence
  Peptide Derived from Human Papillomavirus
LEVDTELSP

SEQ ID NO: 50929 - protein, 9 aa, Artificial Sequence
  Peptide Derived from Human Papillomavirus
VMGDTPEWI

SEQ ID NO: 50930 - protein, 9 aa, Artificial Sequence
  Peptide Derived from Human Papillomavirus
MLDDATTTC

SEQ ID NO: 50931 - protein, 9 aa, Artificial Sequence
  Peptide Derived from Human Papillomavirus
VFKDTYGLS

SEQ ID NO: 50932 - protein, 9 aa, Artificial Sequence
  Peptide Derived from Human Papillomavirus
FPFDKNGNP

SEQ ID NO: 50933 - protein, 9 aa, Artificial Sequence
  Peptide Derived from Human Papillomavirus
YLKDCATMC

SEQ ID NO: 50934 - protein, 9 aa, Artificial Sequence
  Peptide Derived from Human Papillomavirus
FDNELTDES

SEQ ID NO: 50935 - protein, 9 aa, Artificial Sequence
  Peptide Derived from Human Papillomavirus
LHEEEEDAD

SEQ ID NO: 50936 - protein, 9 aa, Artificial Sequence
  Peptide Derived from Human Papillomavirus
VDTELSPRL

SEQ ID NO: 50937 - protein, 9 aa, Artificial Sequence
  Peptide Derived from Human Papillomavirus
VISDDEDEN

SEQ ID NO: 50938 - protein, 9 aa, Artificial Sequence
  Peptide Derived from Human Papillomavirus
FWLEPLTDT

SEQ ID NO: 50939 - protein, 9 aa, Artificial Sequence
  Peptide Derived from Human Papillomavirus
FKSDKTTCT

SEQ ID NO: 50940 - protein, 9 aa, Artificial Sequence
  Peptide Derived from Human Papillomavirus
YVKEGYNTF

SEQ ID NO: 50941 - protein, 9 aa, Artificial Sequence
  Peptide Derived from Human Papillomavirus
LKGDRNSLK

SEQ ID NO: 50942 - protein, 9 aa, Artificial Sequence
  Peptide Derived from Human Papillomavirus
VAWDSVYYM

SEQ ID NO: 50943 - protein, 9 aa, Artificial Sequence
  Peptide Derived from Human Papillomavirus
YKTEDWTLQ

SEQ ID NO: 50944 - protein, 9 aa, Artificial Sequence
  Peptide Derived from Human Papillomavirus
YMTDAGTWD

SEQ ID NO: 50945 - protein, 9 aa, Artificial Sequence
  Peptide Derived from Human Papillomavirus
VYFDGNKDN

SEQ ID NO: 50946 - protein, 9 aa, Artificial Sequence
  Peptide Derived from Human Papillomavirus
YHSETQRTK

SEQ ID NO: 50947 - protein, 9 aa, Artificial Sequence
  Peptide Derived from Human Papillomavirus
IRWENAIFF

SEQ ID NO: 50948 - protein, 9 aa, Artificial Sequence
  Peptide Derived from Human Papillomavirus
FKSECEKYG

SEQ ID NO: 50949 - protein, 9 aa, Artificial Sequence
  Peptide Derived from Human Papillomavirus
VYRDSIPHA

SEQ ID NO: 50950 - protein, 9 aa, Artificial Sequence
  Peptide Derived from Human Papillomavirus
LCTELNTSL

SEQ ID NO: 50951 - protein, 9 aa, Artificial Sequence
  Peptide Derived from Human Papillomavirus
VYGDTLEKL

SEQ ID NO: 50952 - protein, 9 aa, Artificial Sequence
  Peptide Derived from Human Papillomavirus
LHLEPQNEI

SEQ ID NO: 50953 - protein, 9 aa, Artificial Sequence
  Peptide Derived from Human Papillomavirus
IPVDLLCHE

SEQ ID NO: 50954 - protein, 9 aa, Artificial Sequence
  Peptide Derived from Human Papillomavirus
LVVESSADD

SEQ ID NO: 50955 - protein, 9 aa, Artificial Sequence
  Peptide Derived from Human Papillomavirus
LCHEQLSDS

SEQ ID NO: 50956 - protein, 9 aa, Artificial Sequence
  Peptide Derived from Human Papillomavirus
VNTDDYVTP

SEQ ID NO: 50957 - protein, 9 aa, Artificial Sequence
  Peptide Derived from Human Papillomavirus
LRREQLFAR

SEQ ID NO: 50958 - protein, 9 aa, Artificial Sequence
  Peptide Derived from Human Papillomavirus
VTSDSQLFN

SEQ ID NO: 50959 - protein, 9 aa, Artificial Sequence
  Peptide Derived from Human Papillomavirus
VPLDICQSI

SEQ ID NO: 50960 - protein, 9 aa, Artificial Sequence
  Peptide Derived from Human Papillomavirus
FSLDLDQYP

SEQ ID NO: 50961 - protein, 9 aa, Artificial Sequence
  Peptide Derived from Human Papillomavirus
LDLDQYPLG

SEQ ID NO: 50962 - protein, 9 aa, Artificial Sequence
  Peptide Derived from Human Papillomavirus
VLEDGDMVD

SEQ ID NO: 50963 - protein, 9 aa, Artificial Sequence
  Peptide Derived from Human Papillomavirus
ILEDWNFGV

SEQ ID NO: 50964 - protein, 9 aa, Artificial Sequence
  Peptide Derived from Human Papillomavirus
LTADVMSYI

SEQ ID NO: 50965 - protein, 9 aa, Artificial Sequence
  Peptide Derived from Human Papillomavirus
YNPETQRLV

SEQ ID NO: 50966 - protein, 9 aa, Artificial Sequence
  Peptide Derived from Human Papillomavirus
MSADPYGDS

SEQ ID NO: 50967 - protein, 9 aa, Artificial Sequence
  Peptide Derived from Human Papillomavirus
YADDMDPAV

SEQ ID NO: 50968 - protein, 9 aa, Artificial Sequence
  Peptide Derived from Human Papillomavirus
LIEDSSVVT

SEQ ID NO: 50969 - protein, 9 aa, Artificial Sequence
  Peptide Derived from Human Papillomavirus
IYADDMDPA

SEQ ID NO: 50970 - protein, 9 aa, Artificial Sequence
  Peptide Derived from Human Papillomavirus
VVIEPVGPT

SEQ ID NO: 50971 - protein, 9 aa, Artificial Sequence
  Peptide Derived from Human Papillomavirus
FYHDISPIA

SEQ ID NO: 50972 - protein, 9 aa, Artificial Sequence
  Peptide Derived from Human Papillomavirus
ITYDNPAFE

SEQ ID NO: 50973 - protein, 9 aa, Artificial Sequence
  Peptide Derived from Human Papillomavirus
FFADGFVAA

SEQ ID NO: 50974 - protein, 9 aa, Artificial Sequence
  Peptide Derived from Human Papillomavirus
VSDEGDWRD

SEQ ID NO: 50975 - protein, 9 aa, Artificial Sequence
  Peptide Derived from Human Papillomavirus
VMDDSEIAY

SEQ ID NO: 50976 - protein, 9 aa, Artificial Sequence
  Peptide Derived from Human Papillomavirus
ISEDENEDS

SEQ ID NO: 50977 - protein, 9 aa, Artificial Sequence
  Peptide Derived from Human Papillomavirus
VYGETPEWI

SEQ ID NO: 50978 - protein, 9 aa, Artificial Sequence
  Peptide Derived from Human Papillomavirus
MLDDATTPC

SEQ ID NO: 50979 - protein, 9 aa, Artificial Sequence
  Peptide Derived from Human Papillomavirus
ITIEKLLEK

SEQ ID NO: 50980 - protein, 9 aa, Artificial Sequence
  Peptide Derived from Human Papillomavirus
ICIENNSKT

SEQ ID NO: 50981 - protein, 9 aa, Artificial Sequence
  Peptide Derived from Human Papillomavirus
FYVEAVIDR

SEQ ID NO: 50982 - protein, 9 aa, Artificial Sequence
  Peptide Derived from Human Papillomavirus
FPFDKNGNP

SEQ ID NO: 50983 - protein, 9 aa, Artificial Sequence
  Peptide Derived from Human Papillomavirus
IVKDCGTMC

SEQ ID NO: 50984 - protein, 9 aa, Artificial Sequence
  Peptide Derived from Human Papillomavirus
VQVEEQQTT

SEQ ID NO: 50985 - protein, 9 aa, Artificial Sequence
  Peptide Derived from Human Papillomavirus
YDNDVMDDS

SEQ ID NO: 50986 - protein, 9 aa, Artificial Sequence
  Peptide Derived from Human Papillomavirus
LHEEEDKEN

SEQ ID NO: 50987 - protein, 9 aa, Artificial Sequence
  Peptide Derived from Human Papillomavirus
MMLETLNNT

SEQ ID NO: 50988 - protein, 9 aa, Artificial Sequence
  Peptide Derived from Human Papillomavirus
FSSDEISFA

SEQ ID NO: 50989 - protein, 9 aa, Artificial Sequence
  Peptide Derived from Human Papillomavirus
LCIDGQCTV

SEQ ID NO: 50990 - protein, 9 aa, Artificial Sequence
  Peptide Derived from Human Papillomavirus
LKGDANILK

SEQ ID NO: 50991 - protein, 9 aa, Artificial Sequence
  Peptide Derived from Human Papillomavirus
YTVEVQFDG

SEQ ID NO: 50992 - protein, 9 aa, Artificial Sequence
  Peptide Derived from Human Papillomavirus
LRGDSVDSV

SEQ ID NO: 50993 - protein, 9 aa, Artificial Sequence
  Peptide Derived from Human Papillomavirus
YKNEDWTMQ

SEQ ID NO: 50994 - protein, 9 aa, Artificial Sequence
  Peptide Derived from Human Papillomavirus
VFPESVFSS

SEQ ID NO: 50995 - protein, 9 aa, Artificial Sequence
  Peptide Derived from Human Papillomavirus
VCQDKILEH

SEQ ID NO: 50996 - protein, 9 aa, Artificial Sequence
  Peptide Derived from Human Papillomavirus
VQFDGDVHN

SEQ ID NO: 50997 - protein, 9 aa, Artificial Sequence
  Peptide Derived from Human Papillomavirus
IRLECVLMY

SEQ ID NO: 50998 - protein, 9 aa, Artificial Sequence
  Peptide Derived from Human Papillomavirus
IPYDELRLN

SEQ ID NO: 50999 - protein, 9 aa, Artificial Sequence
  Peptide Derived from Human Papillomavirus
VYRDDTPHG

SEQ ID NO: 51000 - protein, 9 aa, Artificial Sequence
  Peptide Derived from Human Papillomavirus
YRDDTPHGV

SEQ ID NO: 51001 - protein, 9 aa, Artificial Sequence
  Peptide Derived from Human Papillomavirus
MRGETPTLQ

SEQ ID NO: 51002 - protein, 9 aa, Artificial Sequence
  Peptide Derived from Human Papillomavirus
ILQELLMGS

SEQ ID NO: 51003 - protein, 9 aa, Artificial Sequence
  Peptide Derived from Human Papillomavirus
YVLDLQPEA

SEQ ID NO: 51004 - protein, 9 aa, Artificial Sequence
  Peptide Derived from Human Papillomavirus
LQPEATDLH

SEQ ID NO: 51005 - protein, 9 aa, Artificial Sequence
  Peptide Derived from Human Papillomavirus
LRREQMFVR

SEQ ID NO: 51006 - protein, 9 aa, Artificial Sequence
  Peptide Derived from Human Papillomavirus
VPTDLYIKG

SEQ ID NO: 51007 - protein, 9 aa, Artificial Sequence
  Peptide Derived from Human Papillomavirus
VTSDAQIFN

SEQ ID NO: 51008 - protein, 9 aa, Artificial Sequence
  Peptide Derived from Human Papillomavirus
VFWEVNLKE

SEQ ID NO: 51009 - protein, 9 aa, Artificial Sequence
  Peptide Derived from Human Papillomavirus
FSADLDQFP

SEQ ID NO: 51010 - protein, 9 aa, Artificial Sequence
  Peptide Derived from Human Papillomavirus
LSADIMTYI

SEQ ID NO: 51011 - protein, 9 aa, Artificial Sequence
  Peptide Derived from Human Papillomavirus
VIQDGDMVD

SEQ ID NO: 51012 - protein, 9 aa, Artificial Sequence
  Peptide Derived from Human Papillomavirus
VPLDICNSI

SEQ ID NO: 51013 - protein, 9 aa, Artificial Sequence
  Peptide Derived from Human Papillomavirus
ILEDWNFGL

SEQ ID NO: 51014 - protein, 9 aa, Artificial Sequence
  Peptide Derived from Human Papillomavirus
VSTDEYVTR

SEQ ID NO: 51015 - protein, 9 aa, Artificial Sequence
  Peptide Derived from Human Papillomavirus
YNPETQRLV

SEQ ID NO: 51016 - protein, 9 aa, Artificial Sequence
  Peptide Derived from Human Papillomavirus
VGLEVGRGQ

SEQ ID NO: 51017 - protein, 9 aa, Artificial Sequence
  Peptide Derived from Human Papillomavirus
MVAEPYGDT

SEQ ID NO: 51018 - protein, 9 aa, Artificial Sequence
  Peptide Derived from Human Papillomavirus
FTVDTPATH

SEQ ID NO: 51019 - protein, 9 aa, Artificial Sequence
  Peptide Derived from Human Papillomavirus
VPIEHAPTQ

SEQ ID NO: 51020 - protein, 9 aa, Artificial Sequence
  Peptide Derived from Human Papillomavirus
LVEESGIVD

SEQ ID NO: 51021 - protein, 9 aa, Artificial Sequence
  Peptide Derived from Human Papillomavirus
ITYENPAYE

SEQ ID NO: 51022 - protein, 9 aa, Artificial Sequence
  Peptide Derived from Human Papillomavirus
IYADTDFTV

SEQ ID NO: 51023 - protein, 9 aa, Artificial Sequence
  Peptide Derived from Human Papillomavirus
IFVDGGDFY

SEQ ID NO: 51024 - protein, 9 aa, Artificial Sequence
  Peptide Derived from Human Papillomavirus
VSIDPVGPL

SEQ ID NO: 51025 - protein, 9 aa, Artificial Sequence
  Peptide Derived from Human Papillomavirus
YYYDISSIN

SEQ ID NO: 51026 - protein, 9 aa, Artificial Sequence
  Peptide Derived from Human Papillomavirus
IAPDPDFLD

SEQ ID NO: 51027 - protein, 9 aa, Artificial Sequence
  Peptide Derived from Human Papillomavirus
FFTDVSVAA

SEQ ID NO: 51028 - protein, 9 aa, Artificial Sequence
  Peptide Derived from Human Papillomavirus
IPMDTFIVS

SEQ ID NO: 51029 - protein, 9 aa, Artificial Sequence
  Peptide Derived from Human Papillomavirus
VNAEESLYF

SEQ ID NO: 51030 - protein, 9 aa, Artificial Sequence
  Peptide Derived from Human Papillomavirus
LTDDSDIAY

SEQ ID NO: 51031 - protein, 9 aa, Artificial Sequence
  Peptide Derived from Human Papillomavirus
VSCETNVDS

SEQ ID NO: 51032 - protein, 9 aa, Artificial Sequence
  Peptide Derived from Human Papillomavirus
IQADTEAAR

SEQ ID NO: 51033 - protein, 9 aa, Artificial Sequence
  Peptide Derived from Human Papillomavirus
MVIEPPKLR

SEQ ID NO: 51034 - protein, 9 aa, Artificial Sequence
  Peptide Derived from Human Papillomavirus
ISEDEDETA

SEQ ID NO: 51035 - protein, 9 aa, Artificial Sequence
  Peptide Derived from Human Papillomavirus
MIDDVTPIS

SEQ ID NO: 51036 - protein, 9 aa, Artificial Sequence
  Peptide Derived from Human Papillomavirus
LIEEEDKEN

SEQ ID NO: 51037 - protein, 9 aa, Artificial Sequence
  Peptide Derived from Human Papillomavirus
FPFDENGNP

SEQ ID NO: 51038 - protein, 9 aa, Artificial Sequence
  Peptide Derived from Human Papillomavirus
FIDDSMENS

SEQ ID NO: 51039 - protein, 9 aa, Artificial Sequence
  Peptide Derived from Human Papillomavirus
LTCDRGIII

SEQ ID NO: 51040 - protein, 9 aa, Artificial Sequence
  Peptide Derived from Human Papillomavirus
IVKDCGIMC

SEQ ID NO: 51041 - protein, 9 aa, Artificial Sequence
  Peptide Derived from Human Papillomavirus
YDNELTDDS

SEQ ID NO: 51042 - protein, 9 aa, Artificial Sequence
  Peptide Derived from Human Papillomavirus
VGDDSEVSC

SEQ ID NO: 51043 - protein, 9 aa, Artificial Sequence
  Peptide Derived from Human Papillomavirus
YIDDYMRNA

SEQ ID NO: 51044 - protein, 9 aa, Artificial Sequence
  Peptide Derived from Human Papillomavirus
FEVEAVIER

SEQ ID NO: 51045 - protein, 9 aa, Artificial Sequence
  Peptide Derived from Human Papillomavirus
FKSDKTSCT

SEQ ID NO: 51046 - protein, 9 aa, Artificial Sequence
  Peptide Derived from Human Papillomavirus
INDENWKSF

SEQ ID NO: 51047 - protein, 9 aa, Artificial Sequence
  Peptide Derived from Human Papillomavirus
IIEEDTCTM

SEQ ID NO: 51048 - protein, 9 aa, Artificial Sequence
  Peptide Derived from Human Papillomavirus
MALETLSKS

SEQ ID NO: 51049 - protein, 9 aa, Artificial Sequence
  Peptide Derived from Human Papillomavirus
FKEDAAKYS

SEQ ID NO: 51050 - protein, 9 aa, Artificial Sequence
  Peptide Derived from Human Papillomavirus
YIIEEDTCT

SEQ ID NO: 51051 - protein, 9 aa, Artificial Sequence
  Peptide Derived from Human Papillomavirus
LKGESNSLK

SEQ ID NO: 51052 - protein, 9 aa, Artificial Sequence
  Peptide Derived from Human Papillomavirus
IEEDTCTMV

SEQ ID NO: 51053 - protein, 9 aa, Artificial Sequence
  Peptide Derived from Human Papillomavirus
YEADKTDLP

SEQ ID NO: 51054 - protein, 9 aa, Artificial Sequence
  Peptide Derived from Human Papillomavirus
IQTDNDNRP

SEQ ID NO: 51055 - protein, 9 aa, Artificial Sequence
  Peptide Derived from Human Papillomavirus
FCADPALDN

SEQ ID NO: 51056 - protein, 9 aa, Artificial Sequence
  Peptide Derived from Human Papillomavirus
FVTEQQQQM

SEQ ID NO: 51057 - protein, 9 aa, Artificial Sequence
  Peptide Derived from Human Papillomavirus
VQYDNDKKN

SEQ ID NO: 51058 - protein, 9 aa, Artificial Sequence
  Peptide Derived from Human Papillomavirus
IRMECALLY

SEQ ID NO: 51059 - protein, 9 aa, Artificial Sequence
  Peptide Derived from Human Papillomavirus
YFKEDAAKY

SEQ ID NO: 51060 - protein, 9 aa, Artificial Sequence
  Peptide Derived from Human Papillomavirus
MFQDTEEKP

SEQ ID NO: 51061 - protein, 9 aa, Artificial Sequence
  Peptide Derived from Human Papillomavirus
VYREGNPFG

SEQ ID NO: 51062 - protein, 9 aa, Artificial Sequence
  Peptide Derived from Human Papillomavirus
YVLDLYPEP

SEQ ID NO: 51063 - protein, 9 aa, Artificial Sequence
  Peptide Derived from Human Papillomavirus
YCYEQLSDS

SEQ ID NO: 51064 - protein, 9 aa, Artificial Sequence
  Peptide Derived from Human Papillomavirus
LYPEPTDLY

SEQ ID NO: 51065 - protein, 9 aa, Artificial Sequence
  Peptide Derived from Human Papillomavirus
VTSDSTYKN

SEQ ID NO: 51066 - protein, 9 aa, Artificial Sequence
  Peptide Derived from Human Papillomavirus
YKNENFKEY

SEQ ID NO: 51067 - protein, 9 aa, Artificial Sequence
  Peptide Derived from Human Papillomavirus
LRREQMFVR

SEQ ID NO: 51068 - protein, 9 aa, Artificial Sequence
  Peptide Derived from Human Papillomavirus
VPDDLYIKG

SEQ ID NO: 51069 - protein, 9 aa, Artificial Sequence
  Peptide Derived from Human Papillomavirus
VTSESQLFN

SEQ ID NO: 51070 - protein, 9 aa, Artificial Sequence
  Peptide Derived from Human Papillomavirus
MNPDILEDW

SEQ ID NO: 51071 - protein, 9 aa, Artificial Sequence
  Peptide Derived from Human Papillomavirus
IIEDGDMVD

SEQ ID NO: 51072 - protein, 9 aa, Artificial Sequence
  Peptide Derived from Human Papillomavirus
FSADLDQFP

SEQ ID NO: 51073 - protein, 9 aa, Artificial Sequence
  Peptide Derived from Human Papillomavirus
VPIDICGST

SEQ ID NO: 51074 - protein, 9 aa, Artificial Sequence
  Peptide Derived from Human Papillomavirus
LTAEVMTYI

SEQ ID NO: 51075 - protein, 9 aa, Artificial Sequence
  Peptide Derived from Human Papillomavirus
ILEDWQFGL

SEQ ID NO: 51076 - protein, 9 aa, Artificial Sequence
  Peptide Derived from Human Papillomavirus
VSTDEYVSR

SEQ ID NO: 51077 - protein, 9 aa, Artificial Sequence
  Peptide Derived from Human Papillomavirus
YNPDTQRLV

SEQ ID NO: 51078 - protein, 9 aa, Artificial Sequence
  Peptide Derived from Human Papillomavirus
VGLEIGRGQ

SEQ ID NO: 51079 - protein, 9 aa, Artificial Sequence
  Peptide Derived from Human Papillomavirus
MTSEPYGDS

SEQ ID NO: 51080 - protein, 9 aa, Artificial Sequence
  Peptide Derived from Human Papillomavirus
VPNEQYELQ

SEQ ID NO: 51081 - protein, 9 aa, Artificial Sequence
  Peptide Derived from Human Papillomavirus
IVVDGADFV

SEQ ID NO: 51082 - protein, 9 aa, Artificial Sequence
  Peptide Derived from Human Papillomavirus
FDPEDTLQF

SEQ ID NO: 51083 - protein, 9 aa, Artificial Sequence
  Peptide Derived from Human Papillomavirus
ITYDNPAFE

SEQ ID NO: 51084 - protein, 9 aa, Artificial Sequence
  Peptide Derived from Human Papillomavirus
LIEETSFIE

SEQ ID NO: 51085 - protein, 9 aa, Artificial Sequence
  Peptide Derived from Human Papillomavirus
VYADDVDNV

SEQ ID NO: 51086 - protein, 9 aa, Artificial Sequence
  Peptide Derived from Human Papillomavirus
YYQDLSPIV

SEQ ID NO: 51087 - protein, 9 aa, Artificial Sequence
  Peptide Derived from Human Papillomavirus
VTVDTVGPL

SEQ ID NO: 51088 - protein, 9 aa, Artificial Sequence
  Peptide Derived from Human Papillomavirus
FPFDTIVVD

SEQ ID NO: 51089 - protein, 9 aa, Artificial Sequence
  Peptide Derived from Human Papillomavirus
VPLDHTVPN

SEQ ID NO: 51090 - protein, 9 aa, Artificial Sequence
  Peptide Derived from Human Papillomavirus
VSTDSSNVT

SEQ ID NO: 51091 - protein, 9 aa, Artificial Sequence
  Peptide Derived from Human Papillomavirus
YADDVDNVH

SEQ ID NO: 51092 - protein, 9 aa, Artificial Sequence
  Peptide Derived from Human Papillomavirus
IPMDTFVVS

SEQ ID NO: 51093 - protein, 9 aa, Artificial Sequence
  Peptide Derived from Human Papillomavirus
IGTDPPTAA

SEQ ID NO: 51094 - protein, 9 aa, Artificial Sequence
  Peptide Derived from Human Papillomavirus
VQNDAQVLH

SEQ ID NO: 51095 - protein, 9 aa, Artificial Sequence
  Peptide Derived from Human Papillomavirus
LTDESDMAF

SEQ ID NO: 51096 - protein, 9 aa, Artificial Sequence
  Peptide Derived from Human Papillomavirus
MLIEPPKLR

SEQ ID NO: 51097 - protein, 9 aa, Artificial Sequence
  Peptide Derived from Human Papillomavirus
ISDDEDETA

SEQ ID NO: 51098 - protein, 9 aa, Artificial Sequence
  Peptide Derived from Human Papillomavirus
LSVDTDLSP

SEQ ID NO: 51099 - protein, 9 aa, Artificial Sequence
  Peptide Derived from Human Papillomavirus
VSGDTPEWI

SEQ ID NO: 51100 - protein, 9 aa, Artificial Sequence
  Peptide Derived from Human Papillomavirus
MLDDATHTC

SEQ ID NO: 51101 - protein, 9 aa, Artificial Sequence
  Peptide Derived from Human Papillomavirus
VFKDIYGLS

SEQ ID NO: 51102 - protein, 9 aa, Artificial Sequence
  Peptide Derived from Human Papillomavirus
FFVETIVEK

SEQ ID NO: 51103 - protein, 9 aa, Artificial Sequence
  Peptide Derived from Human Papillomavirus
FWLEPLADT

SEQ ID NO: 51104 - protein, 9 aa, Artificial Sequence
  Peptide Derived from Human Papillomavirus
FPFDKNGNP

SEQ ID NO: 51105 - protein, 9 aa, Artificial Sequence
  Peptide Derived from Human Papillomavirus
YLKDCAVMC

SEQ ID NO: 51106 - protein, 9 aa, Artificial Sequence
  Peptide Derived from Human Papillomavirus
VDTDLSPRL

SEQ ID NO: 51107 - protein, 9 aa, Artificial Sequence
  Peptide Derived from Human Papillomavirus
FDNDLTDES

SEQ ID NO: 51108 - protein, 9 aa, Artificial Sequence
  Peptide Derived from Human Papillomavirus
LHEDDEDAD

SEQ ID NO: 51109 - protein, 9 aa, Artificial Sequence
  Peptide Derived from Human Papillomavirus
VISDDEDET

SEQ ID NO: 51110 - protein, 9 aa, Artificial Sequence
  Peptide Derived from Human Papillomavirus
FKSDKTTCT

SEQ ID NO: 51111 - protein, 9 aa, Artificial Sequence
  Peptide Derived from Human Papillomavirus
YIKDGDTTY

SEQ ID NO: 51112 - protein, 9 aa, Artificial Sequence
  Peptide Derived from Human Papillomavirus
LKGDKNSLK

SEQ ID NO: 51113 - protein, 9 aa, Artificial Sequence
  Peptide Derived from Human Papillomavirus
VVWDSIYYI

SEQ ID NO: 51114 - protein, 9 aa, Artificial Sequence
  Peptide Derived from Human Papillomavirus
YNNEEWTLQ

SEQ ID NO: 51115 - protein, 9 aa, Artificial Sequence
  Peptide Derived from Human Papillomavirus
YITETGIWD

SEQ ID NO: 51116 - protein, 9 aa, Artificial Sequence
  Peptide Derived from Human Papillomavirus
VYFDGNKDN

SEQ ID NO: 51117 - protein, 9 aa, Artificial Sequence
  Peptide Derived from Human Papillomavirus
YNSEVQRNT

SEQ ID NO: 51118 - protein, 9 aa, Artificial Sequence
  Peptide Derived from Human Papillomavirus
IRLENAILF

SEQ ID NO: 51119 - protein, 9 aa, Artificial Sequence
  Peptide Derived from Human Papillomavirus
FKSECEKYG

SEQ ID NO: 51120 - protein, 9 aa, Artificial Sequence
  Peptide Derived from Human Papillomavirus
VYRDCIAYA

SEQ ID NO: 51121 - protein, 9 aa, Artificial Sequence
  Peptide Derived from Human Papillomavirus
LCTELNTSL

SEQ ID NO: 51122 - protein, 9 aa, Artificial Sequence
  Peptide Derived from Human Papillomavirus
VYGETLEKI

SEQ ID NO: 51123 - protein, 9 aa, Artificial Sequence
  Peptide Derived from Human Papillomavirus
LHLEPQNEL

SEQ ID NO: 51124 - protein, 9 aa, Artificial Sequence
  Peptide Derived from Human Papillomavirus
LTVESSADD

SEQ ID NO: 51125 - protein, 9 aa, Artificial Sequence
  Peptide Derived from Human Papillomavirus
LCYEQLSES

SEQ ID NO: 51126 - protein, 9 aa, Artificial Sequence
  Peptide Derived from Human Papillomavirus
VNTDDYVSR

SEQ ID NO: 51127 - protein, 9 aa, Artificial Sequence
  Peptide Derived from Human Papillomavirus
LRREQLFAR

SEQ ID NO: 51128 - protein, 9 aa, Artificial Sequence
  Peptide Derived from Human Papillomavirus
VPTDLYIKG

SEQ ID NO: 51129 - protein, 9 aa, Artificial Sequence
  Peptide Derived from Human Papillomavirus
VPLDICQSI

SEQ ID NO: 51130 - protein, 9 aa, Artificial Sequence
  Peptide Derived from Human Papillomavirus
FSSDLDQYP

SEQ ID NO: 51131 - protein, 9 aa, Artificial Sequence
  Peptide Derived from Human Papillomavirus
IIEDGDMVD

SEQ ID NO: 51132 - protein, 9 aa, Artificial Sequence
  Peptide Derived from Human Papillomavirus
VMGDTVPTD

SEQ ID NO: 51133 - protein, 9 aa, Artificial Sequence
  Peptide Derived from Human Papillomavirus
YNPETQRLV

SEQ ID NO: 51134 - protein, 9 aa, Artificial Sequence
  Peptide Derived from Human Papillomavirus
LTAEVMSYI

SEQ ID NO: 51135 - protein, 9 aa, Artificial Sequence
  Peptide Derived from Human Papillomavirus
VGMEIGRGQ

SEQ ID NO: 51136 - protein, 9 aa, Artificial Sequence
  Peptide Derived from Human Papillomavirus
MSADPYGDS

SEQ ID NO: 51137 - protein, 9 aa, Artificial Sequence
  Peptide Derived from Human Papillomavirus
LSFEPTSNV

SEQ ID NO: 51138 - protein, 9 aa, Artificial Sequence
  Peptide Derived from Human Papillomavirus
FFADGFVAA

SEQ ID NO: 51139 - protein, 9 aa, Artificial Sequence
  Peptide Derived from Human Papillomavirus
LVEDSSVVA

SEQ ID NO: 51140 - protein, 9 aa, Artificial Sequence
  Peptide Derived from Human Papillomavirus
VYADFPPPA

SEQ ID NO: 51141 - protein, 9 aa, Artificial Sequence
  Peptide Derived from Human Papillomavirus
VVIEPVGPT

SEQ ID NO: 51142 - protein, 9 aa, Artificial Sequence
  Peptide Derived from Human Papillomavirus
FYHDISPIA

SEQ ID NO: 51143 - protein, 9 aa, Artificial Sequence
  Peptide Derived from Human Papillomavirus
VTFDNPAYE

SEQ ID NO: 51144 - protein, 9 aa, Artificial Sequence
  Peptide Derived from Human Papillomavirus
YCPDSVSST

SEQ ID NO: 51145 - protein, 9 aa, Artificial Sequence
  Peptide Derived from Human Papillomavirus
MENESIYCP

SEQ ID NO: 51146 - protein, 9 aa, Artificial Sequence
  Peptide Derived from Human Papillomavirus
IALESLSTT

SEQ ID NO: 51147 - protein, 9 aa, Artificial Sequence
  Peptide Derived from Human Papillomavirus
VWFDGSKNN

SEQ ID NO: 51148 - protein, 9 aa, Artificial Sequence
  Peptide Derived from Human Papillomavirus
YYTDFEQEA

SEQ ID NO: 51149 - protein, 9 aa, Artificial Sequence
  Peptide Derived from Human Papillomavirus
IYKDETQRN

SEQ ID NO: 51150 - protein, 9 aa, Artificial Sequence
  Peptide Derived from Human Papillomavirus
VHMENESIY

SEQ ID NO: 51151 - protein, 9 aa, Artificial Sequence
  Peptide Derived from Human Papillomavirus
FKKEGQHIE

SEQ ID NO: 51152 - protein, 9 aa, Artificial Sequence
  Peptide Derived from Human Papillomavirus
YKDETQRNS

SEQ ID NO: 51153 - protein, 9 aa, Artificial Sequence
  Peptide Derived from Human Papillomavirus
YNNEEWTLR

SEQ ID NO: 51154 - protein, 9 aa, Artificial Sequence
  Peptide Derived from Human Papillomavirus
LKGEPNRLK

SEQ ID NO: 51155 - protein, 9 aa, Artificial Sequence
  Peptide Derived from Human Papillomavirus
YNGDCGWQK

SEQ ID NO: 51156 - protein, 9 aa, Artificial Sequence
  Peptide Derived from Human Papillomavirus
LFVDVTSTY

SEQ ID NO: 51157 - protein, 9 aa, Artificial Sequence
  Peptide Derived from Human Papillomavirus
YRDDFPYAV

SEQ ID NO: 51158 - protein, 9 aa, Artificial Sequence
  Peptide Derived from Human Papillomavirus
VYRDDFPYA

SEQ ID NO: 51159 - protein, 9 aa, Artificial Sequence
  Peptide Derived from Human Papillomavirus
VQLDIQSTK

SEQ ID NO: 51160 - protein, 9 aa, Artificial Sequence
  Peptide Derived from Human Papillomavirus
VVLELTPQT

SEQ ID NO: 51161 - protein, 9 aa, Artificial Sequence
  Peptide Derived from Human Papillomavirus
IPAELYLKG

SEQ ID NO: 51162 - protein, 9 aa, Artificial Sequence
  Peptide Derived from Human Papillomavirus
IFLDVGAVN

SEQ ID NO: 51163 - protein, 9 aa, Artificial Sequence
  Peptide Derived from Human Papillomavirus
ITSEAQLFN

SEQ ID NO: 51164 - protein, 9 aa, Artificial Sequence
  Peptide Derived from Human Papillomavirus
VPLDIVQST

SEQ ID NO: 51165 - protein, 9 aa, Artificial Sequence
  Peptide Derived from Human Papillomavirus
LSAEVMAYL

SEQ ID NO: 51166 - protein, 9 aa, Artificial Sequence
  Peptide Derived from Human Papillomavirus
IYRDPPLHY

SEQ ID NO: 51167 - protein, 9 aa, Artificial Sequence
  Peptide Derived from Human Papillomavirus
LLEDWNIGL

SEQ ID NO: 51168 - protein, 9 aa, Artificial Sequence
  Peptide Derived from Human Papillomavirus
FSTDLDQFP

SEQ ID NO: 51169 - protein, 9 aa, Artificial Sequence
  Peptide Derived from Human Papillomavirus
VATDSYVKR

SEQ ID NO: 51170 - protein, 9 aa, Artificial Sequence
  Peptide Derived from Human Papillomavirus
YNPDQERLV

SEQ ID NO: 51171 - protein, 9 aa, Artificial Sequence
  Peptide Derived from Human Papillomavirus
VGLEVGRGQ

SEQ ID NO: 51172 - protein, 9 aa, Artificial Sequence
  Peptide Derived from Human Papillomavirus
LRREQLFAR

SEQ ID NO: 51173 - protein, 9 aa, Artificial Sequence
  Peptide Derived from Human Papillomavirus
MSADAYGDS

SEQ ID NO: 51174 - protein, 9 aa, Artificial Sequence
  Peptide Derived from Human Papillomavirus
VTKDNTKTN

SEQ ID NO: 51175 - protein, 9 aa, Artificial Sequence
  Peptide Derived from Human Papillomavirus
VSADNPLFE

SEQ ID NO: 51176 - protein, 9 aa, Artificial Sequence
  Peptide Derived from Human Papillomavirus
FFADGDVAA

SEQ ID NO: 51177 - protein, 9 aa, Artificial Sequence
  Peptide Derived from Human Papillomavirus
LVEESSVIE

SEQ ID NO: 51178 - protein, 9 aa, Artificial Sequence
  Peptide Derived from Human Papillomavirus
VAPDPDFMN

SEQ ID NO: 51179 - protein, 9 aa, Artificial Sequence
  Peptide Derived from Human Papillomavirus
VTHDVYIQG

SEQ ID NO: 51180 - protein, 9 aa, Artificial Sequence
  Peptide Derived from Human Papillomavirus
IVVESVGPT

SEQ ID NO: 51181 - protein, 9 aa, Artificial Sequence
  Peptide Derived from Human Papillomavirus
YYYDISPIA

SEQ ID NO: 51182 - protein, 9 aa, Artificial Sequence
  Peptide Derived from Human Papillomavirus
LFIDPPVIE

SEQ ID NO: 51183 - protein, 9 aa, Artificial Sequence
  Peptide Derived from Human Papillomavirus
IDDEAPGLS

SEQ ID NO: 51184 - protein, 15 aa, Artificial Sequence
  Peptide Derived from Human Papillomavirus
AICIEKQSRAAKRRL

SEQ ID NO: 51185 - protein, 15 aa, Artificial Sequence
  Peptide Derived from Human Papillomavirus
GNLVSMDVKHRPLVQ

SEQ ID NO: 51186 - protein, 15 aa, Artificial Sequence
  Peptide Derived from Human Papillomavirus
LYGAANTGKSLFGMS

SEQ ID NO: 51187 - protein, 15 aa, Artificial Sequence
  Peptide Derived from Human Papillomavirus
NINAGTDSRWPYLHN

SEQ ID NO: 51188 - protein, 15 aa, Artificial Sequence
  Peptide Derived from Human Papillomavirus
NPVYELNDKNWKSFF

SEQ ID NO: 51189 - protein, 15 aa, Artificial Sequence
  Peptide Derived from Human Papillomavirus
QQMLQVEGRHETETP

SEQ ID NO: 51190 - protein, 15 aa, Artificial Sequence
  Peptide Derived from Human Papillomavirus
TPSIADSIKTLLQQY

SEQ ID NO: 51191 - protein, 15 aa, Artificial Sequence
  Peptide Derived from Human Papillomavirus
WNYIDDNLRNALDGN

SEQ ID NO: 51192 - protein, 15 aa, Artificial Sequence
  Peptide Derived from Human Papillomavirus
YVEAVVEKKTGDAIS

SEQ ID NO: 51193 - protein, 15 aa, Artificial Sequence
  Peptide Derived from Human Papillomavirus
DGDICNTMHYTNWTH

SEQ ID NO: 51194 - protein, 15 aa, Artificial Sequence
  Peptide Derived from Human Papillomavirus
ILTAFNSSHKGRINC

SEQ ID NO: 51195 - protein, 15 aa, Artificial Sequence
  Peptide Derived from Human Papillomavirus
IRTYFVQFKDDAEKY

SEQ ID NO: 51196 - protein, 15 aa, Artificial Sequence
  Peptide Derived from Human Papillomavirus
LTAFNSSHKGRINCN

SEQ ID NO: 51197 - protein, 15 aa, Artificial Sequence
  Peptide Derived from Human Papillomavirus
RDQFLSQVKIPKTIT

SEQ ID NO: 51198 - protein, 15 aa, Artificial Sequence
  Peptide Derived from Human Papillomavirus
YTAVSSTWHWTGHNV

SEQ ID NO: 51199 - protein, 15 aa, Artificial Sequence
  Peptide Derived from Human Papillomavirus
CTELQTTIHDIILEC

SEQ ID NO: 51200 - protein, 15 aa, Artificial Sequence
  Peptide Derived from Human Papillomavirus
QKPLCPEEKQRHLDK

SEQ ID NO: 51201 - protein, 15 aa, Artificial Sequence
  Peptide Derived from Human Papillomavirus
AANAGVDNRECISMD

SEQ ID NO: 51202 - protein, 15 aa, Artificial Sequence
  Peptide Derived from Human Papillomavirus
FVTVVDTTRSTNMSL

SEQ ID NO: 51203 - protein, 15 aa, Artificial Sequence
  Peptide Derived from Human Papillomavirus
GGTLEDTYRFVTSQA

SEQ ID NO: 51204 - protein, 15 aa, Artificial Sequence
  Peptide Derived from Human Papillomavirus
PLGVGISGHPLLNKL

SEQ ID NO: 51205 - protein, 15 aa, Artificial Sequence
  Peptide Derived from Human Papillomavirus
RECISMDYKQTQLCL

SEQ ID NO: 51206 - protein, 15 aa, Artificial Sequence
  Peptide Derived from Human Papillomavirus
SQAIACQKHTPPAPK

SEQ ID NO: 51207 - protein, 15 aa, Artificial Sequence
  Peptide Derived from Human Papillomavirus
ATQLYKTCKQAGTCP

SEQ ID NO: 51208 - protein, 15 aa, Artificial Sequence
  Peptide Derived from Human Papillomavirus
HRPALTSRRTGIRYS

SEQ ID NO: 51209 - protein, 15 aa, Artificial Sequence
  Peptide Derived from Human Papillomavirus
KRSAKRTKRASATQL

SEQ ID NO: 51210 - protein, 15 aa, Artificial Sequence
  Peptide Derived from Human Papillomavirus
PSTYTTTSHAALPTS

SEQ ID NO: 51211 - protein, 15 aa, Artificial Sequence
  Peptide Derived from Human Papillomavirus
FTDLVRNFKSDKTTC

SEQ ID NO: 51212 - protein, 15 aa, Artificial Sequence
  Peptide Derived from Human Papillomavirus
GNPISIDRKHKPLIQ

SEQ ID NO: 51213 - protein, 15 aa, Artificial Sequence
  Peptide Derived from Human Papillomavirus
ISFVNSTSHFWLEPL

SEQ ID NO: 51214 - protein, 15 aa, Artificial Sequence
  Peptide Derived from Human Papillomavirus
KDLLKVNNKQGAMLA

SEQ ID NO: 51215 - protein, 15 aa, Artificial Sequence
  Peptide Derived from Human Papillomavirus
KSFLKGTPKKNCLVF

SEQ ID NO: 51216 - protein, 15 aa, Artificial Sequence
  Peptide Derived from Human Papillomavirus
NPVYEINDKNWKCFF

SEQ ID NO: 51217 - protein, 15 aa, Artificial Sequence
  Peptide Derived from Human Papillomavirus
PILLTTNIHPAKDNR

SEQ ID NO: 51218 - protein, 15 aa, Artificial Sequence
  Peptide Derived from Human Papillomavirus
YVQAIVDKKTGDVIS

SEQ ID NO: 51219 - protein, 15 aa, Artificial Sequence
  Peptide Derived from Human Papillomavirus
IDHYENDSKDIDSQI

SEQ ID NO: 51220 - protein, 15 aa, Artificial Sequence
  Peptide Derived from Human Papillomavirus
TGILTVTYHSETQRT

SEQ ID NO: 51221 - protein, 15 aa, Artificial Sequence
  Peptide Derived from Human Papillomavirus
YNTFYIEFKSECEKY

SEQ ID NO: 51222 - protein, 15 aa, Artificial Sequence
  Peptide Derived from Human Papillomavirus
YRDISSTWHWTGAGN

SEQ ID NO: 51223 - protein, 15 aa, Artificial Sequence
  Peptide Derived from Human Papillomavirus
AGHYRGQCHSCCNRA

SEQ ID NO: 51224 - protein, 15 aa, Artificial Sequence
  Peptide Derived from Human Papillomavirus
ARRAEPQRHTMLCMC

SEQ ID NO: 51225 - protein, 15 aa, Artificial Sequence
  Peptide Derived from Human Papillomavirus
APSATTSSKPAKRVR

SEQ ID NO: 51226 - protein, 15 aa, Artificial Sequence
  Peptide Derived from Human Papillomavirus
KDAAPAENKDPYDKL

SEQ ID NO: 51227 - protein, 15 aa, Artificial Sequence
  Peptide Derived from Human Papillomavirus
PLGVGLSGHPFYNKL

SEQ ID NO: 51228 - protein, 15 aa, Artificial Sequence
  Peptide Derived from Human Papillomavirus
RDNVSVDYKQTQLCI

SEQ ID NO: 51229 - protein, 15 aa, Artificial Sequence
  Peptide Derived from Human Papillomavirus
TSNVSEDVRDNVSVD

SEQ ID NO: 51230 - protein, 15 aa, Artificial Sequence
  Peptide Derived from Human Papillomavirus
TTSLVDTYRFVQSVA

SEQ ID NO: 51231 - protein, 15 aa, Artificial Sequence
  Peptide Derived from Human Papillomavirus
DTTLTFDPRSDVPDS

SEQ ID NO: 51232 - protein, 15 aa, Artificial Sequence
  Peptide Derived from Human Papillomavirus
HRPALTSRRGTVRFS

SEQ ID NO: 51233 - protein, 15 aa, Artificial Sequence
  Peptide Derived from Human Papillomavirus
VTDLYKTCKQSGTCP

SEQ ID NO: 51234 - protein, 15 aa, Artificial Sequence
  Peptide Derived from Human Papillomavirus
AICIENNSKTAKRRL

SEQ ID NO: 51235 - protein, 15 aa, Artificial Sequence
  Peptide Derived from Human Papillomavirus
CVDYNISPRLKAICI

SEQ ID NO: 51236 - protein, 15 aa, Artificial Sequence
  Peptide Derived from Human Papillomavirus
GNPVSIDVKHKALMQ

SEQ ID NO: 51237 - protein, 15 aa, Artificial Sequence
  Peptide Derived from Human Papillomavirus
IHGAPNTGKSYFGMS

SEQ ID NO: 51238 - protein, 15 aa, Artificial Sequence
  Peptide Derived from Human Papillomavirus
KHKALMQLKCPPLLI

SEQ ID NO: 51239 - protein, 15 aa, Artificial Sequence
  Peptide Derived from Human Papillomavirus
NINAGKDDRWPYLHS

SEQ ID NO: 51240 - protein, 15 aa, Artificial Sequence
  Peptide Derived from Human Papillomavirus
NPVYELSDKNWKSFF

SEQ ID NO: 51241 - protein, 15 aa, Artificial Sequence
  Peptide Derived from Human Papillomavirus
DGDVHNTMHYTNWKF

SEQ ID NO: 51242 - protein, 15 aa, Artificial Sequence
  Peptide Derived from Human Papillomavirus
EVQFDGDVHNTMHYT

SEQ ID NO: 51243 - protein, 15 aa, Artificial Sequence
  Peptide Derived from Human Papillomavirus
FVNFTEEAKKYGTGK

SEQ ID NO: 51244 - protein, 15 aa, Artificial Sequence
  Peptide Derived from Human Papillomavirus
GIYYVHEGHITYFVN

SEQ ID NO: 51245 - protein, 15 aa, Artificial Sequence
  Peptide Derived from Human Papillomavirus
LEHYENDSKRLCDHI

SEQ ID NO: 51246 - protein, 15 aa, Artificial Sequence
  Peptide Derived from Human Papillomavirus
LTYISTSQRDDFLNT

SEQ ID NO: 51247 - protein, 15 aa, Artificial Sequence
  Peptide Derived from Human Papillomavirus
RDDFLNTVKIPNTVS

SEQ ID NO: 51248 - protein, 15 aa, Artificial Sequence
  Peptide Derived from Human Papillomavirus
VRRATTSTKRPRTEP

SEQ ID NO: 51249 - protein, 15 aa, Artificial Sequence
  Peptide Derived from Human Papillomavirus
YEQVSSTWHWTCTDG

SEQ ID NO: 51250 - protein, 15 aa, Artificial Sequence
  Peptide Derived from Human Papillomavirus
QRPLCPEEKQRHLDK

SEQ ID NO: 51251 - protein, 15 aa, Artificial Sequence
  Peptide Derived from Human Papillomavirus
IVTFCCQCKSTLRLC

SEQ ID NO: 51252 - protein, 15 aa, Artificial Sequence
  Peptide Derived from Human Papillomavirus
DFTALQDTKSNVPLD

SEQ ID NO: 51253 - protein, 15 aa, Artificial Sequence
  Peptide Derived from Human Papillomavirus
FVTVVDTTRSTNMSV

SEQ ID NO: 51254 - protein, 15 aa, Artificial Sequence
  Peptide Derived from Human Papillomavirus
PLGVGISGHPLLNKF

SEQ ID NO: 51255 - protein, 15 aa, Artificial Sequence
  Peptide Derived from Human Papillomavirus
RECISMDYKQTQLCL

SEQ ID NO: 51256 - protein, 15 aa, Artificial Sequence
  Peptide Derived from Human Papillomavirus
SGSLEDTYRFVTSQA

SEQ ID NO: 51257 - protein, 15 aa, Artificial Sequence
  Peptide Derived from Human Papillomavirus
ATQLYQTCKAAGTCP

SEQ ID NO: 51258 - protein, 15 aa, Artificial Sequence
  Peptide Derived from Human Papillomavirus
HRPALTSRRNTVRYS

SEQ ID NO: 51259 - protein, 15 aa, Artificial Sequence
  Peptide Derived from Human Papillomavirus
PTPAETSGHLLLSSS

SEQ ID NO: 51260 - protein, 15 aa, Artificial Sequence
  Peptide Derived from Human Papillomavirus
SLYFSNTSHNIAPDP

SEQ ID NO: 51261 - protein, 15 aa, Artificial Sequence
  Peptide Derived from Human Papillomavirus
TGYVPLSTRPSTVSE

SEQ ID NO: 51262 - protein, 15 aa, Artificial Sequence
  Peptide Derived from Human Papillomavirus
YSKATQQVKVIDPTF

SEQ ID NO: 51263 - protein, 15 aa, Artificial Sequence
  Peptide Derived from Human Papillomavirus
EVEAVIERRTGDNIS

SEQ ID NO: 51264 - protein, 15 aa, Artificial Sequence
  Peptide Derived from Human Papillomavirus
GNEISIDVKHRALVQ

SEQ ID NO: 51265 - protein, 13 aa, Artificial Sequence
  Peptide Derived from Human Papillomavirus
KCSAGENTRSLRS

SEQ ID NO: 51266 - protein, 15 aa, Artificial Sequence
  Peptide Derived from Human Papillomavirus
KHRALVQLKCPPLLL

SEQ ID NO: 51267 - protein, 15 aa, Artificial Sequence
  Peptide Derived from Human Papillomavirus
LDLIEEEDKENHGGN

SEQ ID NO: 51268 - protein, 15 aa, Artificial Sequence
  Peptide Derived from Human Papillomavirus
NTNAGTDSRWPYLHS

SEQ ID NO: 51269 - protein, 15 aa, Artificial Sequence
  Peptide Derived from Human Papillomavirus
SPSVAESLKVLIKQH

SEQ ID NO: 51270 - protein, 15 aa, Artificial Sequence
  Peptide Derived from Human Papillomavirus
ECALLYTAKQMGFSH

SEQ ID NO: 51271 - protein, 15 aa, Artificial Sequence
  Peptide Derived from Human Papillomavirus
QQMFLGTVKIPPTVQ

SEQ ID NO: 51272 - protein, 15 aa, Artificial Sequence
  Peptide Derived from Human Papillomavirus
TVQYDNDKKNTMDYT

SEQ ID NO: 51273 - protein, 15 aa, Artificial Sequence
  Peptide Derived from Human Papillomavirus
YSSMSSTWHWTSDNK

SEQ ID NO: 51274 - protein, 15 aa, Artificial Sequence
  Peptide Derived from Human Papillomavirus
LPMMCINFHAQHMTQ

SEQ ID NO: 51275 - protein, 15 aa, Artificial Sequence
  Peptide Derived from Human Papillomavirus
CQALETTIHNIELQC

SEQ ID NO: 51276 - protein, 15 aa, Artificial Sequence
  Peptide Derived from Human Papillomavirus
GNTLEQTVKKPLNEI

SEQ ID NO: 51277 - protein, 15 aa, Artificial Sequence
  Peptide Derived from Human Papillomavirus
KRHVDLNKRFHNISG

SEQ ID NO: 51278 - protein, 15 aa, Artificial Sequence
  Peptide Derived from Human Papillomavirus
QRPLCPQEKKRHVDL

SEQ ID NO: 51279 - protein, 15 aa, Artificial Sequence
  Peptide Derived from Human Papillomavirus
FVTVVDTTRSTNMTL

SEQ ID NO: 51280 - protein, 15 aa, Artificial Sequence
  Peptide Derived from Human Papillomavirus
IYYYAGSSRLLAVGH

SEQ ID NO: 51281 - protein, 15 aa, Artificial Sequence
  Peptide Derived from Human Papillomavirus
KRAAPTSTRTSSAKR

SEQ ID NO: 51282 - protein, 15 aa, Artificial Sequence
  Peptide Derived from Human Papillomavirus
PLGVGISGHPLLNKF

SEQ ID NO: 51283 - protein, 15 aa, Artificial Sequence
  Peptide Derived from Human Papillomavirus
RECLSMDYKQTQLCL

SEQ ID NO: 51284 - protein, 15 aa, Artificial Sequence
  Peptide Derived from Human Papillomavirus
SASLQDTYRFVTSQA

SEQ ID NO: 51285 - protein, 15 aa, Artificial Sequence
  Peptide Derived from Human Papillomavirus
ATQLYQTCKATGTCP

SEQ ID NO: 51286 - protein, 15 aa, Artificial Sequence
  Peptide Derived from Human Papillomavirus
DPAFLTSPHKLITYD

SEQ ID NO: 51287 - protein, 12 aa, Artificial Sequence
  Peptide Derived from Human Papillomavirus
FPYFFTDVRVAA

SEQ ID NO: 51288 - protein, 15 aa, Artificial Sequence
  Peptide Derived from Human Papillomavirus
HRPAITSRRHTVRFS

SEQ ID NO: 51289 - protein, 15 aa, Artificial Sequence
  Peptide Derived from Human Papillomavirus
PAPAEASGHFIFSSP

SEQ ID NO: 51290 - protein, 15 aa, Artificial Sequence
  Peptide Derived from Human Papillomavirus
FTDLVRNFKSDKTTC

SEQ ID NO: 51291 - protein, 15 aa, Artificial Sequence
  Peptide Derived from Human Papillomavirus
GNPISIDRKHKPLLQ

SEQ ID NO: 51292 - protein, 15 aa, Artificial Sequence
  Peptide Derived from Human Papillomavirus
ISFVNSNSHFWLEPL

SEQ ID NO: 51293 - protein, 15 aa, Artificial Sequence
  Peptide Derived from Human Papillomavirus
KEFLKGTPKKNCILL

SEQ ID NO: 51294 - protein, 15 aa, Artificial Sequence
  Peptide Derived from Human Papillomavirus
KELLQASNKKAAMLA

SEQ ID NO: 51295 - protein, 15 aa, Artificial Sequence
  Peptide Derived from Human Papillomavirus
NPVYEINDKNWKCFF

SEQ ID NO: 51296 - protein, 15 aa, Artificial Sequence
  Peptide Derived from Human Papillomavirus
DTTYYVQFKSECEKY

SEQ ID NO: 51297 - protein, 15 aa, Artificial Sequence
  Peptide Derived from Human Papillomavirus
ENAILFTAREHGITK

SEQ ID NO: 51298 - protein, 15 aa, Artificial Sequence
  Peptide Derived from Human Papillomavirus
LDHYENDSKDINSQI

SEQ ID NO: 51299 - protein, 15 aa, Artificial Sequence
  Peptide Derived from Human Papillomavirus
QCGLTEQHHGRVNTH

SEQ ID NO: 51300 - protein, 15 aa, Artificial Sequence
  Peptide Derived from Human Papillomavirus
YSEISSTWHWTGCNK

SEQ ID NO: 51301 - protein, 15 aa, Artificial Sequence
  Peptide Derived from Human Papillomavirus
FHSIAGQYRGQCNTC

SEQ ID NO: 51302 - protein, 15 aa, Artificial Sequence
  Peptide Derived from Human Papillomavirus
ARRAEPQRHKILCVC

SEQ ID NO: 51303 - protein, 15 aa, Artificial Sequence
  Peptide Derived from Human Papillomavirus
FVTVVDTTRSTNLTL

SEQ ID NO: 51304 - protein, 15 aa, Artificial Sequence
  Peptide Derived from Human Papillomavirus
PLGIGLSGHPFYNKL

SEQ ID NO: 51305 - protein, 15 aa, Artificial Sequence
  Peptide Derived from Human Papillomavirus
RDNVSVDYKQTQLCI

SEQ ID NO: 51306 - protein, 15 aa, Artificial Sequence
  Peptide Derived from Human Papillomavirus
TAVITQDVRDNVSVD

SEQ ID NO: 51307 - protein, 15 aa, Artificial Sequence
  Peptide Derived from Human Papillomavirus
TTSLVDTYRFVQSVA

SEQ ID NO: 51308 - protein, 15 aa, Artificial Sequence
  Peptide Derived from Human Papillomavirus
ATDLYRTCKQSGTCP

SEQ ID NO: 51309 - protein, 15 aa, Artificial Sequence
  Peptide Derived from Human Papillomavirus
ATMFTRSGKQIGGRV

SEQ ID NO: 51310 - protein, 15 aa, Artificial Sequence
  Peptide Derived from Human Papillomavirus
HRPALSSRRGTVRFS

SEQ ID NO: 51311 - protein, 15 aa, Artificial Sequence
  Peptide Derived from Human Papillomavirus
YSRANQQVRVSTSQF

SEQ ID NO: 51312 - protein, 15 aa, Artificial Sequence
  Peptide Derived from Human Papillomavirus
FVDVTSTYHWTSTDN

SEQ ID NO: 51313 - protein, 15 aa, Artificial Sequence
  Peptide Derived from Human Papillomavirus
GIYYVHDGHKTYYTD

SEQ ID NO: 51314 - protein, 15 aa, Artificial Sequence
  Peptide Derived from Human Papillomavirus
NQDAAVSHRPGKRPR

SEQ ID NO: 51315 - protein, 15 aa, Artificial Sequence
  Peptide Derived from Human Papillomavirus
PDSVSSTCRYNVSPV

SEQ ID NO: 51316 - protein, 15 aa, Artificial Sequence
  Peptide Derived from Human Papillomavirus
SRSINNNNHPGDKTT

SEQ ID NO: 51317 - protein, 15 aa, Artificial Sequence
  Peptide Derived from Human Papillomavirus
YTDFEQEAKKFGCKN

SEQ ID NO: 51318 - protein, 15 aa, Artificial Sequence
  Peptide Derived from Human Papillomavirus
EKQLHCDRKRRFHLI

SEQ ID NO: 51319 - protein, 15 aa, Artificial Sequence
  Peptide Derived from Human Papillomavirus
QSPLTPEEKQLHCDR

SEQ ID NO: 51320 - protein, 15 aa, Artificial Sequence
  Peptide Derived from Human Papillomavirus
YNFACTELKLVYRDD

SEQ ID NO: 51321 - protein, 15 aa, Artificial Sequence
  Peptide Derived from Human Papillomavirus
DFKVLQESKAEVPLD

SEQ ID NO: 51322 - protein, 15 aa, Artificial Sequence
  Peptide Derived from Human Papillomavirus
FVTVVDTTRSTNMTI

SEQ ID NO: 51323 - protein, 15 aa, Artificial Sequence
  Peptide Derived from Human Papillomavirus
KPAVATSKKRSAPTS

SEQ ID NO: 51324 - protein, 15 aa, Artificial Sequence
  Peptide Derived from Human Papillomavirus
LDIVQSTCKYPDYLK

SEQ ID NO: 51325 - protein, 15 aa, Artificial Sequence
  Peptide Derived from Human Papillomavirus
NNNVIEDSRDNISVD

SEQ ID NO: 51326 - protein, 15 aa, Artificial Sequence
  Peptide Derived from Human Papillomavirus
PLGAGLSGHPLFNRL

SEQ ID NO: 51327 - protein, 15 aa, Artificial Sequence
  Peptide Derived from Human Papillomavirus
RDNISVDGKQTQLCI

SEQ ID NO: 51328 - protein, 15 aa, Artificial Sequence
  Peptide Derived from Human Papillomavirus
SKPAVATSKKRSAPT

SEQ ID NO: 51329 - protein, 15 aa, Artificial Sequence
  Peptide Derived from Human Papillomavirus
ATQLYKTCKLSGTCP

SEQ ID NO: 51330 - protein, 15 aa, Artificial Sequence
  Peptide Derived from Human Papillomavirus
GRKATIQTRRGTQIG

SEQ ID NO: 51331 - protein, 15 aa, Artificial Sequence
  Peptide Derived from Human Papillomavirus
HRPAFTTRRGGVRFS

SEQ ID NO: 51332 - protein, 15 aa, Artificial Sequence
  Peptide Derived from Human Papillomavirus
QSVATPSAHLPIKPS

SEQ ID NO: 51333 - protein, 15 aa, Artificial Sequence
  Peptide Derived from Human Papillomavirus
YRKAFQQVKVTDPAF

SEQ ID NO: 51334 - protein, 9 aa, Artificial Sequence
  Peptide Derived from Human Papillomavirus
IEKQSRAAK

SEQ ID NO: 51335 - protein, 9 aa, Artificial Sequence
  Peptide Derived from Human Papillomavirus
VSMDVKHRP

SEQ ID NO: 51336 - protein, 9 aa, Artificial Sequence
  Peptide Derived from Human Papillomavirus
AANTGKSLF

SEQ ID NO: 51337 - protein, 9 aa, Artificial Sequence
  Peptide Derived from Human Papillomavirus
AGTDSRWPY

SEQ ID NO: 51338 - protein, 9 aa, Artificial Sequence
  Peptide Derived from Human Papillomavirus
YELNDKNWK

SEQ ID NO: 51339 - protein, 9 aa, Artificial Sequence
  Peptide Derived from Human Papillomavirus
LQVEGRHET

SEQ ID NO: 51340 - protein, 9 aa, Artificial Sequence
  Peptide Derived from Human Papillomavirus
IADSIKTLL

SEQ ID NO: 51341 - protein, 9 aa, Artificial Sequence
  Peptide Derived from Human Papillomavirus
IDDNLRNAL

SEQ ID NO: 51342 - protein, 9 aa, Artificial Sequence
  Peptide Derived from Human Papillomavirus
AVVEKKTGD

SEQ ID NO: 51343 - protein, 9 aa, Artificial Sequence
  Peptide Derived from Human Papillomavirus
ICNTMHYTN

SEQ ID NO: 51344 - protein, 9 aa, Artificial Sequence
  Peptide Derived from Human Papillomavirus
AFNSSHKGR

SEQ ID NO: 51345 - protein, 9 aa, Artificial Sequence
  Peptide Derived from Human Papillomavirus
YFVQFKDDA

SEQ ID NO: 51346 - protein, 9 aa, Artificial Sequence
  Peptide Derived from Human Papillomavirus
FNSSHKGRI

SEQ ID NO: 51347 - protein, 9 aa, Artificial Sequence
  Peptide Derived from Human Papillomavirus
FLSQVKIPK

SEQ ID NO: 51348 - protein, 9 aa, Artificial Sequence
  Peptide Derived from Human Papillomavirus
VSSTWHWTG

SEQ ID NO: 51349 - protein, 9 aa, Artificial Sequence
  Peptide Derived from Human Papillomavirus
LQTTIHDII

SEQ ID NO: 51350 - protein, 9 aa, Artificial Sequence
  Peptide Derived from Human Papillomavirus
LCPEEKQRH

SEQ ID NO: 51351 - protein, 9 aa, Artificial Sequence
  Peptide Derived from Human Papillomavirus
AGVDNRECI

SEQ ID NO: 51352 - protein, 9 aa, Artificial Sequence
  Peptide Derived from Human Papillomavirus
VVDTTRSTN

SEQ ID NO: 51353 - protein, 9 aa, Artificial Sequence
  Peptide Derived from Human Papillomavirus
LEDTYRFVT

SEQ ID NO: 51354 - protein, 9 aa, Artificial Sequence
  Peptide Derived from Human Papillomavirus
VGISGHPLL

SEQ ID NO: 51355 - protein, 9 aa, Artificial Sequence
  Peptide Derived from Human Papillomavirus
ISMDYKQTQ

SEQ ID NO: 51356 - protein, 9 aa, Artificial Sequence
  Peptide Derived from Human Papillomavirus
IACQKHTPP

SEQ ID NO: 51357 - protein, 9 aa, Artificial Sequence
  Peptide Derived from Human Papillomavirus
LYKTCKQAG

SEQ ID NO: 51358 - protein, 9 aa, Artificial Sequence
  Peptide Derived from Human Papillomavirus
ALTSRRTGI

SEQ ID NO: 51359 - protein, 9 aa, Artificial Sequence
  Peptide Derived from Human Papillomavirus
AKRTKRASA

SEQ ID NO: 51360 - protein, 9 aa, Artificial Sequence
  Peptide Derived from Human Papillomavirus
YTTTSHAAL

SEQ ID NO: 51361 - protein, 9 aa, Artificial Sequence
  Peptide Derived from Human Papillomavirus
LVRNFKSDK

SEQ ID NO: 51362 - protein, 9 aa, Artificial Sequence
  Peptide Derived from Human Papillomavirus
ISIDRKHKP

SEQ ID NO: 51363 - protein, 9 aa, Artificial Sequence
  Peptide Derived from Human Papillomavirus
VNSTSHFWL

SEQ ID NO: 51364 - protein, 9 aa, Artificial Sequence
  Peptide Derived from Human Papillomavirus
LKVNNKQGA

SEQ ID NO: 51365 - protein, 9 aa, Artificial Sequence
  Peptide Derived from Human Papillomavirus
LKGTPKKNC

SEQ ID NO: 51366 - protein, 9 aa, Artificial Sequence
  Peptide Derived from Human Papillomavirus
YEINDKNWK

SEQ ID NO: 51367 - protein, 9 aa, Artificial Sequence
  Peptide Derived from Human Papillomavirus
LTTNIHPAK

SEQ ID NO: 51368 - protein, 9 aa, Artificial Sequence
  Peptide Derived from Human Papillomavirus
AIVDKKTGD

SEQ ID NO: 51369 - protein, 9 aa, Artificial Sequence
  Peptide Derived from Human Papillomavirus
YENDSKDID

SEQ ID NO: 51370 - protein, 9 aa, Artificial Sequence
  Peptide Derived from Human Papillomavirus
LTVTYHSET

SEQ ID NO: 51371 - protein, 9 aa, Artificial Sequence
  Peptide Derived from Human Papillomavirus
FYIEFKSEC

SEQ ID NO: 51372 - protein, 9 aa, Artificial Sequence
  Peptide Derived from Human Papillomavirus
ISSTWHWTG

SEQ ID NO: 51373 - protein, 9 aa, Artificial Sequence
  Peptide Derived from Human Papillomavirus
YRGQCHSCC

SEQ ID NO: 51374 - protein, 9 aa, Artificial Sequence
  Peptide Derived from Human Papillomavirus
AEPQRHTML

SEQ ID NO: 51375 - protein, 9 aa, Artificial Sequence
  Peptide Derived from Human Papillomavirus
ATTSSKPAK

SEQ ID NO: 51376 - protein, 9 aa, Artificial Sequence
  Peptide Derived from Human Papillomavirus
APAENKDPY

SEQ ID NO: 51377 - protein, 9 aa, Artificial Sequence
  Peptide Derived from Human Papillomavirus
VGLSGHPFY

SEQ ID NO: 51378 - protein, 9 aa, Artificial Sequence
  Peptide Derived from Human Papillomavirus
VSVDYKQTQ

SEQ ID NO: 51379 - protein, 9 aa, Artificial Sequence
  Peptide Derived from Human Papillomavirus
VSEDVRDNV

SEQ ID NO: 51380 - protein, 9 aa, Artificial Sequence
  Peptide Derived from Human Papillomavirus
LVDTYRFVQ

SEQ ID NO: 51381 - protein, 9 aa, Artificial Sequence
  Peptide Derived from Human Papillomavirus
LTFDPRSDV

SEQ ID NO: 51382 - protein, 9 aa, Artificial Sequence
  Peptide Derived from Human Papillomavirus
ALTSRRGTV

SEQ ID NO: 51383 - protein, 9 aa, Artificial Sequence
  Peptide Derived from Human Papillomavirus
LYKTCKQSG

SEQ ID NO: 51384 - protein, 9 aa, Artificial Sequence
  Peptide Derived from Human Papillomavirus
IENNSKTAK

SEQ ID NO: 51385 - protein, 9 aa, Artificial Sequence
  Peptide Derived from Human Papillomavirus
YNISPRLKA

SEQ ID NO: 51386 - protein, 9 aa, Artificial Sequence
  Peptide Derived from Human Papillomavirus
VSIDVKHKA

SEQ ID NO: 51387 - protein, 9 aa, Artificial Sequence
  Peptide Derived from Human Papillomavirus
APNTGKSYF

SEQ ID NO: 51388 - protein, 9 aa, Artificial Sequence
  Peptide Derived from Human Papillomavirus
ALMQLKCPP

SEQ ID NO: 51389 - protein, 9 aa, Artificial Sequence
  Peptide Derived from Human Papillomavirus
AGKDDRWPY

SEQ ID NO: 51390 - protein, 9 aa, Artificial Sequence
  Peptide Derived from Human Papillomavirus
YELSDKNWK

SEQ ID NO: 51391 - protein, 9 aa, Artificial Sequence
  Peptide Derived from Human Papillomavirus
VHNTMHYTN

SEQ ID NO: 51392 - protein, 9 aa, Artificial Sequence
  Peptide Derived from Human Papillomavirus
FDGDVHNTM

SEQ ID NO: 51393 - protein, 9 aa, Artificial Sequence
  Peptide Derived from Human Papillomavirus
FTEEAKKYG

SEQ ID NO: 51394 - protein, 9 aa, Artificial Sequence
  Peptide Derived from Human Papillomavirus
YVHEGHITY

SEQ ID NO: 51395 - protein, 9 aa, Artificial Sequence
  Peptide Derived from Human Papillomavirus
YENDSKRLC

SEQ ID NO: 51396 - protein, 9 aa, Artificial Sequence
  Peptide Derived from Human Papillomavirus
ISTSQRDDF

SEQ ID NO: 51397 - protein, 9 aa, Artificial Sequence
  Peptide Derived from Human Papillomavirus
FLNTVKIPN

SEQ ID NO: 51398 - protein, 9 aa, Artificial Sequence
  Peptide Derived from Human Papillomavirus
ATTSTKRPR

SEQ ID NO: 51399 - protein, 9 aa, Artificial Sequence
  Peptide Derived from Human Papillomavirus
VSSTWHWTC

SEQ ID NO: 51400 - protein, 9 aa, Artificial Sequence
  Peptide Derived from Human Papillomavirus
LCPEEKQRH

SEQ ID NO: 51401 - protein, 9 aa, Artificial Sequence
  Peptide Derived from Human Papillomavirus
FCCQCKSTL

SEQ ID NO: 51402 - protein, 9 aa, Artificial Sequence
  Peptide Derived from Human Papillomavirus
ALQDTKSNV

SEQ ID NO: 51403 - protein, 9 aa, Artificial Sequence
  Peptide Derived from Human Papillomavirus
VVDTTRSTN

SEQ ID NO: 51404 - protein, 9 aa, Artificial Sequence
  Peptide Derived from Human Papillomavirus
VGISGHPLL

SEQ ID NO: 51405 - protein, 9 aa, Artificial Sequence
  Peptide Derived from Human Papillomavirus
ISMDYKQTQ

SEQ ID NO: 51406 - protein, 9 aa, Artificial Sequence
  Peptide Derived from Human Papillomavirus
LEDTYRFVT

SEQ ID NO: 51407 - protein, 9 aa, Artificial Sequence
  Peptide Derived from Human Papillomavirus
LYQTCKAAG

SEQ ID NO: 51408 - protein, 9 aa, Artificial Sequence
  Peptide Derived from Human Papillomavirus
ALTSRRNTV

SEQ ID NO: 51409 - protein, 9 aa, Artificial Sequence
  Peptide Derived from Human Papillomavirus
AETSGHLLL

SEQ ID NO: 51410 - protein, 9 aa, Artificial Sequence
  Peptide Derived from Human Papillomavirus
FSNTSHNIA

SEQ ID NO: 51411 - protein, 9 aa, Artificial Sequence
  Peptide Derived from Human Papillomavirus
VPLSTRPST

SEQ ID NO: 51412 - protein, 9 aa, Artificial Sequence
  Peptide Derived from Human Papillomavirus
ATQQVKVID

SEQ ID NO: 51413 - protein, 9 aa, Artificial Sequence
  Peptide Derived from Human Papillomavirus
AVIERRTGD

SEQ ID NO: 51414 - protein, 9 aa, Artificial Sequence
  Peptide Derived from Human Papillomavirus
ISIDVKHRA

SEQ ID NO: 51415 - protein, 9 aa, Artificial Sequence
  Peptide Derived from Human Papillomavirus
AGENTRSLR

SEQ ID NO: 51416 - protein, 9 aa, Artificial Sequence
  Peptide Derived from Human Papillomavirus
ALVQLKCPP

SEQ ID NO: 51417 - protein, 9 aa, Artificial Sequence
  Peptide Derived from Human Papillomavirus
IEEEDKENH

SEQ ID NO: 51418 - protein, 9 aa, Artificial Sequence
  Peptide Derived from Human Papillomavirus
AGTDSRWPY

SEQ ID NO: 51419 - protein, 9 aa, Artificial Sequence
  Peptide Derived from Human Papillomavirus
VAESLKVLI

SEQ ID NO: 51420 - protein, 9 aa, Artificial Sequence
  Peptide Derived from Human Papillomavirus
LLYTAKQMG

SEQ ID NO: 51421 - protein, 9 aa, Artificial Sequence
  Peptide Derived from Human Papillomavirus
FLGTVKIPP

SEQ ID NO: 51422 - protein, 9 aa, Artificial Sequence
  Peptide Derived from Human Papillomavirus
YDNDKKNTM

SEQ ID NO: 51423 - protein, 9 aa, Artificial Sequence
  Peptide Derived from Human Papillomavirus
MSSTWHWTS

SEQ ID NO: 51424 - protein, 9 aa, Artificial Sequence
  Peptide Derived from Human Papillomavirus
MCINFHAQH

SEQ ID NO: 51425 - protein, 9 aa, Artificial Sequence
  Peptide Derived from Human Papillomavirus
LETTIHNIE

SEQ ID NO: 51426 - protein, 9 aa, Artificial Sequence
  Peptide Derived from Human Papillomavirus
LEQTVKKPL

SEQ ID NO: 51427 - protein, 9 aa, Artificial Sequence
  Peptide Derived from Human Papillomavirus
VDLNKRFHN

SEQ ID NO: 51428 - protein, 9 aa, Artificial Sequence
  Peptide Derived from Human Papillomavirus
LCPQEKKRH

SEQ ID NO: 51429 - protein, 9 aa, Artificial Sequence
  Peptide Derived from Human Papillomavirus
VVDTTRSTN

SEQ ID NO: 51430 - protein, 9 aa, Artificial Sequence
  Peptide Derived from Human Papillomavirus
YAGSSRLLA

SEQ ID NO: 51431 - protein, 9 aa, Artificial Sequence
  Peptide Derived from Human Papillomavirus
APTSTRTSS

SEQ ID NO: 51432 - protein, 9 aa, Artificial Sequence
  Peptide Derived from Human Papillomavirus
VGISGHPLL

SEQ ID NO: 51433 - protein, 9 aa, Artificial Sequence
  Peptide Derived from Human Papillomavirus
LSMDYKQTQ

SEQ ID NO: 51434 - protein, 9 aa, Artificial Sequence
  Peptide Derived from Human Papillomavirus
LQDTYRFVT

SEQ ID NO: 51435 - protein, 9 aa, Artificial Sequence
  Peptide Derived from Human Papillomavirus
LYQTCKATG

SEQ ID NO: 51436 - protein, 9 aa, Artificial Sequence
  Peptide Derived from Human Papillomavirus
FLTSPHKLI

SEQ ID NO: 51437 - protein, 9 aa, Artificial Sequence
  Peptide Derived from Human Papillomavirus
FFTDVRVAA

SEQ ID NO: 51438 - protein, 9 aa, Artificial Sequence
  Peptide Derived from Human Papillomavirus
AITSRRHTV

SEQ ID NO: 51439 - protein, 9 aa, Artificial Sequence
  Peptide Derived from Human Papillomavirus
AEASGHFIF

SEQ ID NO: 51440 - protein, 9 aa, Artificial Sequence
  Peptide Derived from Human Papillomavirus
LVRNFKSDK

SEQ ID NO: 51441 - protein, 9 aa, Artificial Sequence
  Peptide Derived from Human Papillomavirus
ISIDRKHKP

SEQ ID NO: 51442 - protein, 9 aa, Artificial Sequence
  Peptide Derived from Human Papillomavirus
VNSNSHFWL

SEQ ID NO: 51443 - protein, 9 aa, Artificial Sequence
  Peptide Derived from Human Papillomavirus
LKGTPKKNC

SEQ ID NO: 51444 - protein, 9 aa, Artificial Sequence
  Peptide Derived from Human Papillomavirus
LQASNKKAA

SEQ ID NO: 51445 - protein, 9 aa, Artificial Sequence
  Peptide Derived from Human Papillomavirus
YEINDKNWK

SEQ ID NO: 51446 - protein, 9 aa, Artificial Sequence
  Peptide Derived from Human Papillomavirus
YYVQFKSEC

SEQ ID NO: 51447 - protein, 9 aa, Artificial Sequence
  Peptide Derived from Human Papillomavirus
ILFTAREHG

SEQ ID NO: 51448 - protein, 9 aa, Artificial Sequence
  Peptide Derived from Human Papillomavirus
YENDSKDIN

SEQ ID NO: 51449 - protein, 9 aa, Artificial Sequence
  Peptide Derived from Human Papillomavirus
LTEQHHGRV

SEQ ID NO: 51450 - protein, 9 aa, Artificial Sequence
  Peptide Derived from Human Papillomavirus
ISSTWHWTG

SEQ ID NO: 51451 - protein, 9 aa, Artificial Sequence
  Peptide Derived from Human Papillomavirus
IAGQYRGQC

SEQ ID NO: 51452 - protein, 9 aa, Artificial Sequence
  Peptide Derived from Human Papillomavirus
AEPQRHKIL

SEQ ID NO: 51453 - protein, 9 aa, Artificial Sequence
  Peptide Derived from Human Papillomavirus
VVDTTRSTN

SEQ ID NO: 51454 - protein, 9 aa, Artificial Sequence
  Peptide Derived from Human Papillomavirus
IGLSGHPFY

SEQ ID NO: 51455 - protein, 9 aa, Artificial Sequence
  Peptide Derived from Human Papillomavirus
VSVDYKQTQ

SEQ ID NO: 51456 - protein, 9 aa, Artificial Sequence
  Peptide Derived from Human Papillomavirus
ITQDVRDNV

SEQ ID NO: 51457 - protein, 9 aa, Artificial Sequence
  Peptide Derived from Human Papillomavirus
LVDTYRFVQ

SEQ ID NO: 51458 - protein, 9 aa, Artificial Sequence
  Peptide Derived from Human Papillomavirus
LYRTCKQSG

SEQ ID NO: 51459 - protein, 9 aa, Artificial Sequence
  Peptide Derived from Human Papillomavirus
FTRSGKQIG

SEQ ID NO: 51460 - protein, 9 aa, Artificial Sequence
  Peptide Derived from Human Papillomavirus
ALSSRRGTV

SEQ ID NO: 51461 - protein, 9 aa, Artificial Sequence
  Peptide Derived from Human Papillomavirus
ANQQVRVST

SEQ ID NO: 51462 - protein, 9 aa, Artificial Sequence
  Peptide Derived from Human Papillomavirus
VTSTYHWTS

SEQ ID NO: 51463 - protein, 9 aa, Artificial Sequence
  Peptide Derived from Human Papillomavirus
YVHDGHKTY

SEQ ID NO: 51464 - protein, 9 aa, Artificial Sequence
  Peptide Derived from Human Papillomavirus
AAVSHRPGK

SEQ ID NO: 51465 - protein, 9 aa, Artificial Sequence
  Peptide Derived from Human Papillomavirus
VSSTCRYNV

SEQ ID NO: 51466 - protein, 9 aa, Artificial Sequence
  Peptide Derived from Human Papillomavirus
INNNNHPGD

SEQ ID NO: 51467 - protein, 9 aa, Artificial Sequence
  Peptide Derived from Human Papillomavirus
FEQEAKKFG

SEQ ID NO: 51468 - protein, 9 aa, Artificial Sequence
  Peptide Derived from Human Papillomavirus
LHCDRKRRF

SEQ ID NO: 51469 - protein, 9 aa, Artificial Sequence
  Peptide Derived from Human Papillomavirus
LTPEEKQLH

SEQ ID NO: 51470 - protein, 9 aa, Artificial Sequence
  Peptide Derived from Human Papillomavirus
ACTELKLVY

SEQ ID NO: 51471 - protein, 9 aa, Artificial Sequence
  Peptide Derived from Human Papillomavirus
VLQESKAEV

SEQ ID NO: 51472 - protein, 9 aa, Artificial Sequence
  Peptide Derived from Human Papillomavirus
VVDTTRSTN

SEQ ID NO: 51473 - protein, 9 aa, Artificial Sequence
  Peptide Derived from Human Papillomavirus
VATSKKRSA

SEQ ID NO: 51474 - protein, 9 aa, Artificial Sequence
  Peptide Derived from Human Papillomavirus
VQSTCKYPD

SEQ ID NO: 51475 - protein, 9 aa, Artificial Sequence
  Peptide Derived from Human Papillomavirus
VIEDSRDNI

SEQ ID NO: 51476 - protein, 9 aa, Artificial Sequence
  Peptide Derived from Human Papillomavirus
AGLSGHPLF

SEQ ID NO: 51477 - protein, 9 aa, Artificial Sequence
  Peptide Derived from Human Papillomavirus
ISVDGKQTQ

SEQ ID NO: 51478 - protein, 9 aa, Artificial Sequence
  Peptide Derived from Human Papillomavirus
AVATSKKRS

SEQ ID NO: 51479 - protein, 9 aa, Artificial Sequence
  Peptide Derived from Human Papillomavirus
LYKTCKLSG

SEQ ID NO: 51480 - protein, 9 aa, Artificial Sequence
  Peptide Derived from Human Papillomavirus
ATIQTRRGT

SEQ ID NO: 51481 - protein, 9 aa, Artificial Sequence
  Peptide Derived from Human Papillomavirus
AFTTRRGGV

SEQ ID NO: 51482 - protein, 9 aa, Artificial Sequence
  Peptide Derived from Human Papillomavirus
ATPSAHLPI

SEQ ID NO: 51483 - protein, 9 aa, Artificial Sequence
  Peptide Derived from Human Papillomavirus
AFQQVKVTD

SEQ ID NO: 51484 - protein, 14 aa, Clostridium tetani
QYIKANSKFIGITE

SEQ ID NO: 51485 - protein, 21 aa, Plasmodium falciparum
DIEKKIAKMEKASSVFNVVNS

SEQ ID NO: 51486 - protein, 16 aa, Streptococcus mutans
GAVDSILGGVATYGAA

SEQ ID NO: 51487 - protein, 9 aa, Artificial Sequence
  Artificially Synthesized Peptide
YLEPAIAKY

SEQ ID NO: 51488 - protein, 10 aa, Artificial Sequence
  Artificially Synthesized Peptide
FLPSDYFPSV

SEQ ID NO: 51489 - protein, 9 aa, Artificial Sequence
  Artificially Synthesized Peptide
YVIKVSARV

SEQ ID NO: 51490 - protein, 10 aa, Artificial Sequence
  Artificially Synthesized Peptide
KVFPYALINK

SEQ ID NO: 51491 - protein, 9 aa, Artificial Sequence
  Artificially Synthesized Peptide
AVDLYHFLK

SEQ ID NO: 51492 - protein, 11 aa, Artificial Sequence
  Artificially Synthesized Peptide
STLPETYVVRR

SEQ ID NO: 51493 - protein, 9 aa, Artificial Sequence
  Artificially Synthesized Peptide
AYIDNYNKF

SEQ ID NO: 51494 - protein, 9 aa, Artificial Sequence
  Artificially Synthesized Peptide
APRTLVYLL

SEQ ID NO: 51495 - protein, 9 aa, Artificial Sequence
  Artificially Synthesized Peptide
FPFKYAAAF

SEQ ID NO: 51496 - protein, 13 aa, Artificial Sequence
  Artificially Synthesized Peptide
PKYVKQNTLKLAT

SEQ ID NO: 51497 - protein, 12 aa, Artificial Sequence
  Artificially Synthesized Peptide
YKTIAFDEEARR

SEQ ID NO: 51498 - protein, 14 aa, Artificial Sequence
  Artificially Synthesized Peptide
YARFQSQTTLKQKT

SEQ ID NO: 51499 - protein, 14 aa, Artificial Sequence
  Artificially Synthesized Peptide
QYIKANSKFIGITE

SEQ ID NO: 51500 - protein, 15 aa, Artificial Sequence
  Artificially Synthesized Peptide
EALIHQLKINPYVLS

SEQ ID NO: 51501 - protein, 17 aa, Artificial Sequence
  Artificially Synthesized Peptide
GRTQDENPVVHFFKNIV

SEQ ID NO: 51502 - protein, 13 aa, Artificial Sequence
  Artificially Synthesized Peptide
NGQIGNDPNRDIL

SEQ ID NO: 51503 - protein, 9 aa, Artificial Sequence
  DR7 preferred motif
  VARIANT 1: Xaa = Met, Phe, Leu, Ile, Val, Trp or Tyr
  VARIANT 5, 8: Xaa = Any amino acid
  VARIANT 6: Xaa = Ile, Val, Met, Ser, Ala, Cys, Thr, Pro or Leu
  VARIANT 9: Xaa = Ile or Val
XMWAXXMXX

SEQ ID NO: 51504 - protein, 9 aa, Artificial Sequence
  DR7 deleterious motif
  VARIANT 1, 3, 5, 6: Xaa = Any amino Acid
  VARIANT 7: Xaa = Gly, Arg or Asp
XCXGXXXNG

SEQ ID NO: 51505 - protein, 13 aa, Artificial Sequence
  pan-DR-binding epitope peptide
  VARIANT 1: May be L-alanine or D-alanine
  VARIANT 3: Xaa = Any amino Acid
  VARIANT 13: May be L-alanine or D-alanine
AKXVAAWTLKAAA
